United States Patent 10,407,724 (METHODS AND COMPOSITIONS FOR SCREENING AND TREATING DEVELOPMENTAL DISORDERS) - sequence listing, part 73

SEQ ID NO: 1925 - DNA, 102391 bp, Homo sapiens
gtggaataaaatcctttgttgggtaactttcctcagccataaaaggcaagagggggccaggcactggcatttctgcagagctgtcacaggtcctctgtggttttaagagaaggggaaaaacagttacttttaccccgacagcacctgaagcatgagagtctaaaaccctccacctttgcaacttacatatgccctttcattttttaactccaagaaggccacataaagatttacagggggctcttcagtttcttttgggaagttactgatgttagtctattctctaacttcttggtctagttaccagcaaggtagaaaaaggcagcccagcccctgttaaaacacagcaacaactttatctgaaccaggatggaaatctctccctttttttgtcaacagagttggctatataatatatatatatatatttatatataattttttttcttaatggagatttgatcccagcctggagtgacttcggttgggaattaaagagttttggcttctgggagtaattttgttttcccaattctcagtccaaatgcttacacactggaaaattccaaattaaaagccacagaaaaggaaaggggtttagaacacattatctctttgctcgtacaaagtacaaggcgtttgtttttggatagtacttcacattctgtttcttgtccatgagtcctccaaatatgatgagttcacccctgccttgtaccacggtatgcaggctggtttcaggaggtccaaccacagaactgctattaaatactttccatttgacccgccccttctccttggtgtctttaatgtccagcacgtacatctgcatgggcttgcagttcatactctggtataggggtttgccaacatttagggactgtggagggtggtggcccaggcggcgagcaatgggaggtaaggaatgtccatctccttgggcaggccctgggcgagggatgggcactgtttctccactgctcaaactctggctcccaggagagcctggagaagacccaagaggaggacttagtgctgcagaggccgaggggcctttggaggacatcgctttgatggcttccagactccgacgcagggcacctggggagacggcccctgcaagggcactggccacgtgaggtggggtatgcacaccatttgtctgttcaggagggtgtctcatacttcccccaactgtcctattgtccatgccatccatgggattactactggaagcgggtttcagatcccaattcagatctatggatcctaatctcagatctttctgatctggtagtgatcctcgtcggggggccaaagaaagtcctattttcaggtcgtatccttcaggagcagatggagtacttggagatatggcctgtacaggactgtccaaagaagagccacccacagctgccgttcctggagacaaactcccaccattgaggataggagagccgtctcctctggctggggaaaggctcccttcccgggaacctgaaggagtctgcctttgagccctgggtctcagtgttccccagcggccgttaacacaaggagcttcatccatgcttcttactggagactgagagcggtactctcgggtttcaggaacgagagctggaggagtggcactgataggtgatgggcgagagttcaaactggggctgagtggggctctcccactaggagcctggctgaagaccaccacacactgtcccacctggaagacaaaggaccagtgctcacactcttctatgattctgattgttcattcaactgtcaaacattttatcatgagcatctgtcatgtgccagacattttgtaggtacctgagatatgaagatgaaaatgatgtagtctgccctctaggctagaagtcagacatgggaacaatcgctgctttgtgtgacatatgctatcattagagatatgtatacagaaggggtggggagaagggaacaatcaatttttgttagaaggagaagggaaagtttcacagacaaacagatgcttaaagttgggacttactgaatgagtagggcccctgtaagttttcccatttagtgagaaatgccaaaggagctatggctaatgttcacctcttttgtgacaccaaggtgttttctatttttgtacaaatttctttgtaacctgacaaagtaatgtggttttccacaatttaggacctgtcctcctgctagcctgtcagctccctgcttacccggcaagctggatggcaccacagttctggggccccatgctcttcattttctaccttgagtggctgccaggcccaaggaccagaatgcatgtgcaacaaccaagcatccttgaatagctgtaagagaaaaaaccaataacaagactcaggtgtgatatgcgttccaaaacacacacacacagagttgcagtctcaaagctctcctgtctggtcttgaaaggatgtggactcttcagaaggatagcaaaatcctcagttaattattcagttgtgcatgcatccacttacgctttcattcattcatatattaccactggcttagcacatggaattgtgcttgtgacccatgaatcaactgagtggttttgacacttgcccataattttatgtgtatgtattggggattgaaggagaggataaataatacatatccacaactttctgaatctgctttcttaaatactgtgtgaactctgacagttatcaacctgcttttttgttccactgccctctcccctttgaaaatatgatagcagtaaactttatagcctaaaaaggaaataggaatgggaagaatatagatatgaatattcaagagacaaatatctatgattaaaaggatccccccacaaccctaaaaaaaagcagaaacaaaggccagaaaatacaaaggctatacccaaaaagcattccttaaattaaaatgccatggaaatagtcttgtatactcctagaaaagaagacaggggaaacaggttttgaacacttagtagcatgcacatgggaatgccacagaagcaatactcacagcattgggaccgccacaccctccgaggattaagatagttgcatcatctatgacaatctgaggaggggaagacattgaaaataaacctacaaagacacaggtttctgactttctatgcttcactggtatatgagaatagcctacctagctcccaaatgggaatattctagttaccataacctctccattctcctaaaaacatatcaattctgatccctgtgaataaattactgataattcacctgaaaggatacattctttgttgatcaaatattaacatgaatgtcaaccacataaaatgcaggattctcttgagaaatgacacagcaaagtaaatgctttggggaggagcataatataaaaccactataaataatatgacccattagaagttgaaaaataaataccagtaaaaaagaatgatacattttctttggcttagtgcatattggcatcttacctgactccctcctccctctcccgtcctaactgaaagacgctacagtgtttgctgaatagttattttaattcctgagcacctgagattggccacctcgaggatgaggactggggccagagatgttcggcttggaccacgcccactgctcaaggtcaaggacccagacatcattgctcctgtgaattaaggacagaaggataaaggtagttaggagctcccagggaccataatggtggctggggagttccacatgcctgtggcccatctggcaaacttgcaccattttcactttcacagactgtgtgggctggagcaggttttagagatgccctactcagagttcaggggcttctgaaccagaaagagaccatgttgctgaatcccagctctgtagcctgaacaagtcacttaattttctctaactctgactttatctctaaaatgaaaatactgttactactgtctgaggagctgatataaaatgaagggacctttataaagatgcgcagcaaagtgttatgctcctacttagcacttaggctgtatctttcttcccctactttccctagaagtcatcctgagaccctccctctgctctttccacgaggcctcatctgagccacgtctgcggccagacactagtgcctaatgagattatttttttaaccatctattaactgaagtaaaagcagatgattaaaaaatagttaattggtgacagcaggaaatagacactggttaagctacagttttcaaaagcaaaaaccacaaagaagagaaaaaacgattcaaaaggcagcttcatcattgtccaggagttaaaagctttatcgattctggctacaaaaagtaattgcacaatgactaatgaaagctgcagttttatcaaggacagactggcatctctaaccctcaagggaccaacatgacgaggacagactcctggatggcagtctctctttcatggtcacttaaggtcattgattcacccacaaaaatacaggaataatagttccaatatctgaaatcctaaactctctcattgggagagtagctcctataatctctctccataactgttttaaaatatgaagatggaaatgccctaagggaggacaggtgtgggatggtcttgctgctgacagctcatcaacttccacttcagagcacagggggaatgaccacaactgctgctaccgctgaatcagacagtgatacagatggaatgctctggctcctgactatggcttgagctgtccagtatggccagaagtggacaggacaggaggtagggacaatgacctcacagaaatgtcatgcctgacacagttttcctgttcctacccattccacaacccatcccatttgtttttttcttttctttccttctttctttcttttcatgccctttacatgtggctcaaccaacctatcacatttggagggcccaccatttccacttgtcctgtcaatctccccctcttctcctctaaagcccaaaagggcaagagctgggtaataaagtagaataagtaaaagcattctgttctcgaaagttggccttctgcaggcacagcacagcaggcaaggtggaggttccatcagaatttgatcctactgaatagaaccatatgtcaaagagattctatataactatgattttatagagcaaatttttcaatttattggtctgtgattaagggattaaagaacagaatgctaggatgagataactaattggattaattagagccatgctcaggaatactgaccctaacttactttttttttttttttccttaagagtctcgatctgttgcccaggctggaatgcaatggggtgatcttggctcactgcaatcgccacttcccaggttcaagcgattctcctgccttagtctcccaagtaactgggactacaggtgtgtgccaccatgcccggctaatttttgtatttttagtagagatggggcttcgccatgttcgccatgctggtcacaaactcctgacctcaggtgatccacccaccttggcctcccaaaatgctgggattacaggtgtgaattaggcacctggtccctaattcacttttaaacctgttattcccaggagtatttaccttcaggctcatatggagcaaaccaaatgtacttacatttgccgggatcctaaagagccaccaaagacaatcattttatcatctatcacacaggaggagtggccagccatgggaggtggcccatgggttgtcacaatgcagttccacctaatgtaaaaagacaggaggaagtcaagaagtcagcaccacacactttatgtaaaaatagtaagtaggcatccatttaaaatgataatcctatcactttcagcagagatttgttgggataataagtagaggatggcataatgtatttatgcctttcctacaagtttgcttaaagttatcttctttcaagttctgaatgtaaacggtctggagggagagagatgagaaaacgatgacaagagacaagatcatggcttctttggcctggtttgctgacaaagcaccacctgccacctgctacctttccctatggtcctgatcagtaacagctaacaagcgccacgtactaagtcttccattacaagaaacggcggttgctgtcattaagagatatatgtttgaaaaacaattcagagtaagtcttggagacacagttaggagtaaggaatcatctggatctacaacactcctggagtgttagcagccaaagctgaagagctcgctgttcttcaactggctcattcatttttcttgaaagaggaataaatctcttctattttttctctttagaataaggattctaaatgcagggttctaagagagtcctgtaaactctctgaaactgttggtaaaatctgtgaatatgtgcatttttcccctcctgggaaaagagtccacagctttccatctaattctcaaagggactcttgacacaaaaaaacaaagaatccactgatttaaggccttttcttccagatttaaagagtttatctttgtgacttaccaatttttagagggtgagtaagtgtgtatttcatcaaagaatctctctggctggtgtaggggataagggcttggccgcgtccagccaccaaacagcactagcaagtccttgtacacgaccagagttgctccagctttgggggaaggataggaccctagggaaagtcagtaacaccatggttagcattcaggatctcacaacaatccgtagttaggctatccatagatcacctttccctggaagagcaacaaaaggggaactaatactacaaagtgtagaggaaaggtggaaagaaaactgggtttgagtctgagagaaaatcatcactaattcacacgtcttttattattaacagagaaatatgagttagagaaaagttacttagcctctctcatgtttataatttgctcacctaaaattagggatgagagtacctatctcataaggctgttttgagtattaaatagtatattcaaagcacctaacataatgcctggcacatagaaagtgctcaacaaatgagcaccccttcccatccctttaacaaacttaacagaggtcacaaagaaaagaaagaatgtagaggaccagggagaagtatacatagaggctggatgtctggatgcaacttaaaaataactcgttacaaaacacaggtaagaaaaggaggcaggaggcagttcttatttgtcccgtgagtcaaattttaacatagggacctccaggcccctagctatgggcttcacataaccagatagcctcagcctagcacaaatggggcagaccttcaaggattggtgtgaaggaattccagtgaaaccataagtcttacaccaaacaccatctagactggacctctgggctacactgaccaaattctgaaaaaaaacactttggcttatgctggaaaactttagagataacaaatgtcttacaggagcataatttttcaaaatctattgtctttgaaataacaattgctatttttccccatccctcactctacatgtcacctttagtttcctcaagaccaaagtaacttgtcccaatatccaggtgtcagtaaataccagaatactttttttttcctttggaggtggagtctcgctttgtcacccaggctggagtgcaatgatgcaatctcggctcactgcaacctccacctcctgggttcaagtgattttcctgccttagcctcctgagtagctgggattacaggcatctgccatcatgcccagctaattgttgcatttttagttgagatggggtttcaccatgttggccaggctggtctcaaactcctgacctcaggtgatctacccgctttggcctcccaaagtgctgggattacaggcgtgagccaccatgcctcgctgagaatacttttttttttaaaatcttttttttttctttttggttaaagctgcaggactcatttttcaaaggatatcttaagcagaagaaatcccaacactacattaacctgacagcagtcgagatgctccaatctaggtggagagctttgcttcctctttcagtagcacattacagaacactgtttgaaaagccctgctcagactgctttaatggtgtcacttacaaagtctcaaggttgagaaggtagagcagaggactgtctttcttgtgatctcacttaggggaacaatacgatttactgagaaggcatcagtcctgaagagtacagggtgagcatctaagaacaccatgtggcatcagctatttttcatttcttcttcctttttttttttttgagacagggtcttgctgttgcccaggctggagtgcagtggcacaattacggctcactgcagcctcaacctcctgggctcaagggatcctcccactttaacctcccaaatagctaggaatacaggcaagcaccaccatgcccgactaatttttaaattttttgtagtgatggggactccctgcattgcccagactggtctcgaactcatgggttcaagcaatcctgccgccttggcctttcgaagtgttaggattacaggtgtaagccactgtgcctgtccgtgtcaactattttgaatactttcataaataaaaccaacactaatccagaccacaggaactgactgtagaaatgagtctttatttatttattaatcttgagacagggtctagctttgtcacccaggctagagtgcagtgatgcgatcatggctcactgcagcctcgacttcctcaggctgaagcaatcctcttgcttcagcctctcgagtagcagaggctacaggcatgtaataccatatccagctaatttttaaaatttttttgttgtgatcaggtcttgctatgttgctcaggctggccacgaactcctggcctcaagcgatcctcccgcctcagcctcccaaagtgctgggattataggcattacccacctcacccagtcagaaatcttctctaggaagagttatcacatcaatctgaagtgctgaggtattctctaccctcaaatcccacaagaatagtgattaaagaggctgttgtctttcatatagccttactgttcctggtcaaaaacatttacctccccaaggggatctatctcctagcccaattagaaagcctaagtaatataatggtctagttaaaacacaactattgctctaaaataatttaatttgtgaaataccagacaaagcttccaagttcttgcctctaacttggaaatcatcagtactatgaaacagttagaaaaaagaaaaaacaaataaacacatcacagacttcagcaaaatagtaatgtaaactctctagactagaatgtggatttggatttgagatactgggcttaaagaaattataaatgcagtataagaatatatacctcttgccaggcgcagtggctcacacctgtaatcccagcactttgggaagccaaggcaggcagatcacttaaggtcaggagtttcagaccagtctggccaacatggtgagatcctgtctctattaaaaatattaaaaaattagccaggcatggtagcccacgcctgtaattccagctactcaggaggctgaggcacaagaattgcttgaaactaggaggtggaggttgcagtgagccgagattgagccactgcactctggcctgagtgaaagagcaagactctgtctcaaaaaaaaaaaaaaagaaagaaagaaaaaaaagaaagaaagaatatataccttttaaggtgggacatattcatagaatttttaaaagtattcataaaacatggcatacataatgtaagtagaggaaagactacactttagatctgtactgcccaacaaagtcaccactggccacatgttgcccgtggttatcaaactgaagagcacagatgtaggacatttctatcattgcagaaagttctatttaatagcggtattttagaaaaaggttttaactttgtcaacagtgtgcctatgcttggggattacgggaaagtagcagggatagatgaataacttaactccaagagaaatgacaattattgttactataactcttactactgctactgatggtaatgactaatatttattgagcatctacatctattatgtactatgcagctttttttttttttttttgagacagaatctcactctgtcacccaggctggagtgtaatggcacgatctcggctcactgcaacctctgcctcccaggttcaaattattctcctgtctcagcctcccaagtagctgggattacaggcgtatactgccacgcccggctaattttttgtattttagtagagacggggtttcaccatgttgcccaggctggtctcaaactcctgagctcaggcaatccactggcctcagcctcccaaagtgctaggattacaggtgtgagccaccgcgcctggcccaattactatgcagctttttaagtgctttgcatgtattaattaatttaatccttctaaaattcctagttttattcctattttacagataagaaacctgagggcacaactctttaaataacttgtccaaggtcgtagaactaataagtgaagagccaggattctaatccatttattctggattttaatttttaattttatttttttgagatgaggtctcactctggcacccaggctggagtgcagtggtgtgactgatcatggctcactgcacttctgacctcctgggtgcaagggatctttctacctcagcctcctaagcagctaggactacagtcacaggccactacatccagctaatttttttctttttttgggtagagatgggggtctctctgtgttgcccagactggtcttaaactcctggcctcaagtgattctcccacctctgccacctcccaaagtgctggaattacaggcatgagccacctcaccttaaaagaatgagctttaaagtcagaatatatcatgctgcacttcatgcatacagatacattccttctgaatagttgccacaaacaagtctgatgccttaaaaggtctagtgtttcaaagctgaagaagttctttcttcaatcttaatccggtaaagccaaagacctagtcagagagaagtaaattaaacagaaggctattcttagaacctctttttctctacaaggctctgggacacactccacctctaatataggaccatttacttattctccgaactctccaaggaaaggtaagctgaggccagtgataatgataaatcaatataagagatcctctaggattatcttaggtaagggctttccaaaacgacgtctcagatatcttgaccttttagaaaggcaaaatctttccctctactttttatctcatgaagttggagaactcctccatctagaatttatctccatggcctattttatgtcacaaagtaggagcatcttaaatagctcaacttaatttcagcatcttaattatctcaactaagtaggggaaagttaaatcaattgtatacccccacctcaatttgtgggtgaactggaaaaaaacttaccatacaagaacaaatgaggtggcagagatcaacatacagcttttatacagtgagttcagcaaccagaagtcaaggatacaggtatatcaattttttttttttgtttttgagacgcgtctcactctgtcgctcaggctggagtgcagtggcgcgatctcggctcactgcaagctccacctcccaggttcaagggattctcctgcctcaacctcctgagtagctgggactacaggcaccccccgccatgctcaagctaattttttttattgttgtatttttagtagaggcagggtttcactgtgttagccaggatggtctcgatctcctgaccttgtgatccacccgccttggtctcccaaactgctgggattacaggcgtgagccaccgcgcctggcccaggtatatcaaattttatgtgaccctgagtgcccatataatatttggcatatttattgcaaattggatacttttaaattattgctactttaagaattgatattgtgaagcctttataaagaactcctacttccattatttctaaaaatctacatatttcatatatatgtgtgtgtgtatatgtatatatattttaagatggggtcttgctatgctgcccagtctggtctttaactcctgagctcaagcattcctcttgcctcagcctcctgagtagcttggactacaggagtataccaaaatgcctggctcatatttcatactttgaatttgtttaaagcagatggtccttaattccctctcgatgatcttaaagcaaaatctataaatcaaatgaatttatggtgagatcacatggggtgtggtggctcaagcctgtaatcctagcactttgggaggtcaaggcgggtggatcacttgaggccaggcgtttgaaaccagcctgggcaacatggcaaaaccatgtctctactaaaaatacaaaaattagccaggtgtggtggcatgtgcctgtggtcccaggttcaagaatcgcttgaacctgggaggtggaggttgcagtgagcccagaccgtgcaccagtacacatggggtggtcagagattacgcggatccatcaattttggcaatttctttttctttttgagacagggtctcactccggttgcccaggctagagtctggagtgcagtggcgtaatcgatctcagctcactgcaactccgacttctcaagctcaggtgattctcacacctcagcctcccaagtagctgggactacaggcacgtgccaccacggcaggctagttttttgtaattttagtagagacagcatttcaccatgttgtgtaggctcgtctcaaactcctggattcaagcaatctgcccgcctcggcctcccaaagtgctaggattacaggcgtgagccacaactttggtaatttctatatcaaagaataacattctctttagccaaagtggagttctggaaaacaaacaataagtctctactagaatttcaagaaaaacaagaaaagccatattcaaattacataactttattcatttttttttaagttccaggaaaagcaagccatttaaagagtgcctaagccaggcgcggtggctcatccctgtaatcccagcactttgggaggctgaggcgggcggatcacgaggtcaggagatcgagaccatcctggctaacatggtgaaaaatacaaaaaattagcttgggtgtggtggcaggtgccttgtagtcccagctactcaggaggctgaggcaggagaatggcgtgaacccgccaagcttgcattgagccaagatcacgtcactgcactccagcctgggtggcagagcgagactccatcagaaaaaagagtacctacaaactttctttaaaagcacacggccggccaggcgtggtggatcacctgaggtcagaagttcgagaccagcctgaccaacatggtgaagccccgtctctactaaaaatacaaaaaattagcccggcatggtggtgcacacctgtaatcccagcttcttgtgaggctgaggcaggagaaacgcttgaacccgggaggcagaggttgcagtgagccaagatcgcaccgttgcactccagcctgggcaacaagagcgaaactccgtctcaaggaaaaaaacaaaaaaaaaccgaaaaaccaaaaaacaaaacaaaacaaaacaaaaacaaaaaacccacggccatacattaactttttttttttttttttttggaggcagagtttcactcttttcgcccaggctggagtgcgatggcacaatcttggctcgctgcaacttccacctcccaggttcaagcgattctcctggctcagcctcccgagtagctgggattagaggtgtgtgctaccacacttggctaatttttgtattattagtagagacgaggtttcaccatgttggccaggctggtctcgaactcctggcctcaggtgatccacctgcctcagcctcccaaagtgcagggattacaggcatgagccaccatgccaggccaacaataatttttatatggagtagccgtagataaaatgtcaagtaatgactttgaagaactgcccgaatgtgcatgtaattcattccaaacagcagctacagttatagcacataggtttaatacatttttattaaaacacacatatcttccacactagcacctgagtaactggaaatcttgaacaacatggagtactctcggaatagctgatattcgatagttaaaaaggcacataaccactatggtgacatatgatgaaataaatactgctcctgcaagaacacttataaaatgaaggttttatactcattaggacatttcctggcctgccttcaaaataacaaagccactgggcttctaaattcagtctaagtgccattactgcacaaaagtgaagaaaggaagggtgtcattcccattgagttcccatcaagcacgacaggaccaaatgtgcccacatcaagcgtagatgaacatgttacttgagcctcttcccctagagccctcttcccctagagccaggagtcaccctcatgggcttcattccccaaacacatcaaaggcctcctaaatcgcacagcagatatgatcaatggaacaaatttcaaaacaaggcacaagcccaaaaggcagctgtggcaaactgaataatcagatagacaccctatacaacagaactaacattccctaaaactgctaataggttcagctgtttcccaaggttcctatgaaatcagaataaaatttcacatatgatggtggtataattacacggcattcttgtttacgtttgcaaagaagctggttaaacagtgaagcagttccaaatcctagtttgatttctatgccactttcccacaattgtagtgtctatttacacagaacccaggactacatagagcagctcaactatttgataacaagataaaacaatcacctgttttaattggggatgcctgtattttatgcacgatttaaaaatgtatgtatatattttttgagacggagtttcgctcttgttgcccaggctggagtgaaatggcgcaatctcggctcaccgcagcctctgcctcccagtttcaacggattctcctgcctcagcctcccgagtagctgggattacaggcatgcaccaccaagtggctaattttgtatttttagtaaagatggggtttctccatgttggtcaggctggtctcgaactcccaacctcaggtggtcctcccgtcttggccccccaaagtgctgggattacaggcatgagctaccgtgcccggcctaaaaaatatttttatatctccatgctattatcattttttagtattagtttattgttaaggagttataaataatactgtttgatggcctattatgtgctaactactgagtgctacaaattttatatttattatctaatttaatcattataaccttaaaatgcaggtattactagcctcattttacagatgaataatggtaggtgaagctaatgcataatgcttacactgagctagacactgttctaggtacctcttgaaaactaaaaaagaaaaaaaaaaaggcaaattccatgttctgagtaatcaagaaatccaacctaaagggttatttaatgaaagaagagttaatcccttgtccttggaagtttaggttcagataagtccctattaaaaaaaaaaaaaaagacatttcaaggcctcctaaaggagctctatatggctcacaaagccttttggtccctgatctgcatactacacagttggctctgagtacaggtgtcttaggcaataatagccaaatgtcacaagatgagaagcaggtatataatcctaccattttctcaatatcacttacattctcaacaaatagaactgttactctagtcttacacacttcagacttttggggagaaactgacttatttatttttatttccttaagaaaatgaaagtgctttaaaacactttcaaataaaataatcaaacaagatagaacttttgaaagaaaaagtcagaaccctttctaccccacggaaaatggctattttcatggctgttttcaaagtatagttttttttaaaaaaaatagaaacatctctttcatacatatatagagtaaacatgtgttaggatatatttaacttattaataagggagcaagcaggaagtaatgctaattcaaaggagaatttgaggaaaagagccatgctaaaataagtttgctaacagctaggcacagtggcatgtacctgtagtccccagctactcaggagactgaggcgggaggatggcttaacctcctgccttaagataggttaagtctccccatcttaaccactctgtgcagactcgctttctcagagtgggtccaatataaagcattcacttccaactccagctccacaggcagtataccagtccttcacacacaaaactggccttgagggcaaagtaatgccagatagaccagttaactaaaaccctaccccacagatgctgttttttgttttgttttgtggtagtgaggagcctcaaactggcgtgtgtatggggggtgggaaggatggattttgctgataaaaccaaagctgggtcttggaaagctctgactaagcatctggcttgataaagctgtcatcatggtattgtgtgaagtgactgacctcaacagcaggagttcagagatcaggataatttggacagatatttcccagaataccatattaccatcataatcagaaaacctagagggcactggaggatagcgtggcacatataactttgaaggaaacagattccttaaagaaaaactgctggtgttataatttaactgcttactcaaaactattttgattttacaggcaatacttcgtaagggcaacaacaaaagcatgtttcatggttctgtggtgtgaggaggtagggataaaaggataattgagaaaaacacttcaaaattcatgagtataaagtctgtcttgaccataaacaccttgaagacaactatttggaatggtctccaaaatactgcagcccaaggaccaaggggtttctatctggaacagatactagtttctcttctggtaataaaaatatttccaacttaacatcaatgtggccaataataattacaagtcattgcatttatataaatgcccatgaagatacaagtacataatgctttaaagaaagaaataggaagtaaatacaaagttacagaacctctaaactcctgcttcctaagacttggttctacccaggagtgctctttaattgcagttctaatcaggggtgttgaaattatccatttagattctccccagtaagactacactatcctagaagacagggactatttcttatgaaaatgtttgttgaattgaagccatccacggaagccaaatggttatagatctctcaggagctgagatcagggtcggctccagctacttataacataccctagaggcatcagcccacctttgggtggggttaaagccaaacatttttttgggtctccccctctacccactccatttttttcttcctattttactcctcaattgtaaaaaggccagaaaagttactgattgacatcaacattcactggtattagacaaaacttgtctggatctcaggattcagggtatacattattattacaactatatccacatctttaaaaacatcattctatgggtcatttatgaaatatccaaataacaggaacttttgtaatgggcatgagaaacttttagatcttatctaactatgccacaggcatgaactaaaggaaattctctattggcattgttttcacttcttaacaaaaccatatgaaagaccacttgatgaatagggcagcacttatcagctaaaaatgaacaatacaaaagccagtaatagttccttgttaccatttcaagtagtcttttgattcaatttctgagggaggagaggaggtccaaagtctcagtttaatctgataatttgttaattgcagttctaatgggggtggggggcatagggggtactctttcaagtagggactttaagaagtgaaaacaatgttaccagtcataaagtttctagcctggtgtcaaaacagaaaaatccttgtcagccctgagagtgagccaaactgaaatatggtaaaatcttacttattctctccctgggaggactaaaagttacccagatctgtcctatacaaattttcccactcttctctttagcaggaggtaatgtgtatacaccttagaaaagcatgtattctggaaaaatcccagggtctgaactttctaaataaacaagaaggatttcttccttttctaagggaacctactggctctgctttcattcacatgtcctgagaccatcacaggtccaggttgttacaggactgcaaagggctacaggaaacaaggaagaaccaccacctcatgaagaaggttaaccaggaataggtccatgggtcagggaggagctaatataataacttaaaatattcccttaaataacatcttaactccttcttaatcaaaagcacatcactttaataagaacaaagaggccgggcacagcagctcacgcctgtaatcccagcactttgggaggtcgaggcaggcagatgacctgaggtcgagagttcaagatcagcctgaccaacatggagaaaccccgtctctactaaaaacgaacaaacaaacgaacaaaaaaacaaaatgagctgggtgtggtggcacatgcctgtaatcccagctactcgggaggctgagacaggagaattacttgaacccgggattctccggtctcagcctcccgagtagctgggactacagacacgcatcaccacacccagttaatttttgtattttagcagagatgggagtgtttcaccatgttggccaggctggtctcgaactcctgacctcgtgatccacccacctcggccttccaaagtactgggattacaggcgtgagccaccgcacctggctttttttttttttgtgacagagtctctgtctctgtcacccagactggagtgcagtggtgcaatttcagctcctgggttcaagcgattctcctgcctcagcctcctaagtagctgggactacaggcacatgatatcatacccgcctaattttctatatttttagtagagatgaggttttgtcatgctggccaggctggtctcaaactcttgaccgtgggtgatctgcctgcctcggcctcccaaagtgctgggattacaggtataaaccaccgaacccagacttttttttttttttaagagagtatcactctgttccccaggccggagtgcagtggcactatctcagttcaagccattctcgtgcctcagcttcctgagtagctgaaattatacatgtgccaccacatctggctactcataattttttgtttatttgagacagagtttcgctcttgttgcccaggctggagtgcaatggcgtgatctcggctcactgtaacctccgcctcccaggttcaagcgattttcctgcctcagcctcccgagtagctgggattacaggcatgagccaccatgtccagctaattttgtatttttagtggagacggggtttctccatgttggtcaggctggtctcaaactcccaatctcaggtgatccgcctacctcggcctcccaaagtgctggtattacaggcatgagccaccatgcctggcctattctttatgttttctttgttttttctgttttgttttgttttgttttgtttttgagatggagtttcactctgtcacccaagctggagtgcagtggctcaatctcactgcaacctccgcctcccaggctcaagtgatcttcccacatcagccttccaagtagatgggaccacagacatgcaaaccacagctggctaattttttgtatttttggtatagacagggtttcatcatgttgcttaggttcatctggaactcctgagctcaagtgatcagcctgccaaggcctcccaaggtgctgggattacaggtgtgagccaccacgcccagccactttctcttcttataaagccaccagtccccactcccagtctaacccattaatccaggaacgaattaatccattctgctgtcatgacccaaacacctcttaaagaccccacctctcaatactgctacactggggattaactttcaacacatgtttcagagggaacaaacattcaaaccatggcaagccccatcacttccagtgtctctgctagatggagttaggcagcagtaaatggagaaaacaatttaattaggcctaacaactggacgctgaagtacttaggatttgtccagaaaataattcccaagggaagattggggatgaattcataaatataatcatgtccctttcttttcatcatccttcacttattcaccagagccttcaagataaaggccaggccaggtgcagtggctcacgcctgtaatcccagcactttgtgaggctgaggtgggaagattacttgaggccaggaattcaagaccagcctgagcaatacagagagactctgtctctcaaaaaaaaaaaaaaaaaaaaaagaaaagaaaagaaagaagaaaagataaattccaaatcccttacttaccatgagatacacacacacacacacacacacacacacacacacacacacatataaaattccattctttgagcaactactatgtgccaggtactagagtcagcagtgactaaaacagacaaaaagccctcagccccaggaagcgtatagcttgctgaggggaagaaagacagtgtgacatatggtgataagtgccaaggggggaaaaaaaaaacaaaacaagaggaaaaggagtcagggaagttgtcctttcaaactgtagttagggaatgcctcacagagggagacatatgaataaagacctgtgaagcaggtaaaggagagagtcacaaggacatgcaggaagagtgttccaggcagaaatagcaagagcagaggcccaggtgtgaggctaaaatacagtgagggacaggaatgcagcaggcaatgaggtcagagagatgaggggacaggatgactgtgcaggaccttgtttggccatactttgatccctaactactgtgtgcgtgtgtgtgttggtgtgtgtgtgtgtgtgtgtgtgtgtgtgtgtgtgtgtgtgtgttggcatctaactctgttgcccaggctggagtgcagtggcatgatctcagctcactgcaaccttcgcctcctaggttcaagccactctcctgcctcagcctcccaagtagctgggattacaggcgcctgccaccacacctggctaatttttgtattttaagtagagatggggtttcaccatgttggccaggctggtctcgaactcctgaactcagatgatctgcccacctcagcttcccaaagtgctgggattacatgcatgagccaccgcacctggcccctaactacctttctaatacccacttgtaccactctcccctcacatatcctggctcaggaacacccaacctatttgtaagtccatgaacatgccaaactctcttacctccatccacagccttttttcaatggctatccatagccctcttcatttaccacataagtgtttggttttcttctgctagatggagaacctcttaggattaggaactcctgttacttagtactatacctgcatacctagcatagtcattggatgctcaatagtcctctgtaggctgggcgcagtggctcacacttgtaatctcagccctctgggaggctgaggcgggtggatcacctgaggtcaggagttcgagaccagcctagccaacatggtgaaaccccgtttctaccaaaaaaaaaaaaaagaaaacaatacaaaaatagctgggcgtggtggtgcatgcccatagtcccagctactcgagaggctaaggcaggagaattgcatgaatctgggaggcggaggttgcagtgagccaagattgtgccactgcactccagcctgggggacagagcaagactccgtcccaaaaaaaaaaaaaaaaaaaaagtcctctgtagactgaaatgattaatgtctaacagcatgaagtctggccagatgtccacagagacgcaaactataaggctcactgcaactctcttttttttgagacagagtttcgctcttgttacccaggctggagtgcaatggcacgatcttggctcaccgcaactcccgcctcccgggttcaagcgattcttctgcctcagcctcccgagtagctgggattacaggcatgcaccaccacgcccagctaattttgtattttaagtagagaccgggtttcaccatgttagtcaggctggtttcgaactcctgacctcaagtgatccacccgccttggcctcccaaagtgctgggattacaggcgtgagccaccgtgcccggtgggtcactgcaactctctaataggtaaaggcttggctgaaggaacaagagtatgcacaaaggtagaggtggagagaagggaagattatgcaggatcttgtcagccacactttgatccctaactacctttcctatccctgagacccaaggtggcagcaagtaggatactttgggtaaaaggacatgttagtcatcgaaatttgtgtacataaaaatccatagcttttcctgatgttataacttctagcctttacacgaacaatggctagcatttgatgaattcttaggaatatttcattttcatgaaagtatcaaccagggtccccagaacaggcaactgcaaaaataatcctgttgaatggatgtaaagttcttgtctcgattctttttgtttctttcagattccctagagacaaagccagtttgcctgacctctcaaccaaagaaccctgacaacttactccttagctagtatctccgtatatataaagatgtcaacttcatcatcagttcccagaaaccctctccaactgagtactgtattgtatgtaatatgaacaaaaactatgaaaggtaggtattaccatctctaccctaaaggtaaggcaactggggttaaacaaccggtaaccagcaagtgacagggctcaaatgaaaaagtatgcctcctggcacaaaacccatcatttttatggtattactaacgagcctccttccctcctacaatatcttcctcacattactttaggtcattagcccctaataattagtatcttttattattagccaagtggtctttcctccccaaacttctgtaatacttagttatatcatcagatctttcagatggagcaggactaaggaaatggagagctctctgggatgcttgctatgtctaaaatatctcttaaagttgacaagtaggaaatgagtgcatatatccactgaaaagtacaaacaatgttgatggcagctatattcaaagtagaaacagcccaagtatccatcaacaggagaacaacttaaaaaaaaaaaaaatgagggccgggcatggtggcttatgcctgtaatcgtagcactttggaggctgaggtgggcagatctcttgagcctaggagttcaagaccagcctgggcaacatgatgaaaccctgtctcaacaaaaatacaaaaattaaccgggtgtggtgatgcacatctgtagtcccagctacttgggaggctgaggtgggaggatcacttgagcccaagaggtagaggctgcagtgagccaagattgtgccactgcacactccagcctaggcaacagaacgagactctgtctcaaacaagaaaaaaagtgggatattcatattaagaagcactcatggtaatggaagggaataaactactgacagatgcaaccacatagatgaatctcaaaaacgtgttcaaagaaagaagccagacataaaatactacctatcacagacgtccatttacacgaagttcaagaacacagaactatactttgggaatctgaggcaggaggattgtttgagaccaggcattcaagaccaggctgggagacatagcagtaccccatctctacaaaaactaaattagtcaggcatggtggtgtgcatctgcaatcccagctacttgggaggctgaggcaggaggattgcttgagcccaagagctggagctgcggtgagctatgataatcatgccattgcactgctgcctgggtgacagaatgaaactttgtctcaaaaaacacaaaaaaaaaagaaaagaaaagaaaaaaagaacagaacaaagccacagtgttagaagtcagaataggagctgacctctatgggggttgtacagacaggaaaggggcatgagggggcttttttgaggtgaagaaagttttcgtatcttgatctaggtaatgatcacatgactgtatacatatgtaaaaaacaaaatctctgagttgtgcacttaagatttgctcatttaactataagtaatgtatatcccccccccatacaaattatgcccccgttttttttttttttttttttttgagacgaagtcttgctctgttgccaggctagagtgcagtggcgtgaacttggctcactgcaacctccgcctcctgggttcaaacgattctcctgcctcagcctcgcaagtagctgggactacaggcacccaccaccatgcccagctaattttttgtatttcagtagagacagggtttcatcacgttggccaggattctctcgatctcctgatctcgtaatctgcccgcctcagcctcccacagtgctgggattacaggcgtgagccaccatgcccagctatcaaattatgtcttaatagaataatattgtttttaaaaaaagaatcgctaatgtaaaagctggcagtaaactgtaaaccatgttcatactggtgtcacatggtaccaccaactactttagccagtaagcagaaatatcagcaatccattattagaattaaaattcattatatgaggtctttaagaacccattcatcacataaaatgcaactaccctgtaactcacatatgtaaattcaatagcaagaaacattctgagattcagcagtgggatttcagaaagcttactaaaatgggagagaagacaaaaaagggacacaacataaaagccaacaaatcaaatataaaacccacaacccatcatcacttctagagagaactacagaaaagaggaaattatcaggggcacaatttatttgaaaagtagaatcaattaatgcatagtacatcaggtgcgatggctcatgtctgtaatctcggtacttcgagaggccaaggcagggggatcacttgaggctaggagtgcaagaccagtctgggcattacagtgagacgctgtctctacaaataataaaataaaatagctgggcatagtggttcatgcctgtagtccttgctacttgggaggctgaagcaggaggatcgcttgagcccaggaatttgaggctgcagtgagctatgatgatgccactgtattccactcagggacaaaaagctagaccctgtctcttacccaaaaacagaaaaggaagaataaaaataaaaagccatagttcaagagttcatctcctcaagggggaatgagaaatagcttctgagttttaaaaggacaaaggaggccaggagtggttgctcatgcctgtaatcccagcgctttaggacgctgaggtgggtgaatcacctaaggtcaggagttggagaccagcctggccaacatggcaaaaccccgtctctactaaaaaaattagccaggcgtggtggtggtacgtgcttgtaatcccagctactcgggaggctgagggaggagaattgttgccaagaacagccttggcaacagagtgagaccccgtctcaaaataaataaacaaaaaagggcaaaggagcctcctagaattcaaggtgatatttataagtcaataaacgacccatcacagctcttacccacctaggaacagcacatctcctcacagttatgaaaactggaaaacttggcagggtgcggtggctcacgcctgtaatcccagcactttgggaggccgaggtgggtggatcacgaggtcaggagatcgagaccatcctggctaacacggtgaaaccccgttctactaaaaatacaaaaaattagccgggcatggtggcatgcacctgtagtcccagctattcgggaggctgaggcaggagaatggcgtgaacccaggaggcagagcttgcagtaagccgagatcacaccactgcacaccagcccgggcgacagaccgacactctgtctcaaaaaaaaaaaaaaaaagaaaagaaaagaaaagaaaactggagaacttgagaaactggcctgatcctaattacatagaaactaaacagccaaacattgagcacgagccatgaattggtccatggcactaccaagtgtccttgaaaccaagagggtcattcctgggaagcagaagttagaaatgactcagggatagtatcttgcgttcctctcccatttagaattagcctcttataactacatttaggacataaagttaatctatatagcattggagatatacaaggataaggcatcatatgaaatgaaatttattgtggtaataaaacatgaagtactgttaggagattacatggatacctgagaataagagaaacaatgctagatgatttgagacttttactccatgggggaacccaagagtaaacaaaaactgtccagatggtaggcagacaggatcacagcatgtagatttgaaagctgagaattctaagaaatgtcactgcttattttcactgacactactaaaataagaaggttttattttagatggttttaagaaagaatagaaaagtctcatgagtttgacccaatgactacaagttaaaggaggcaggattttcaacatggaggagaaatagctaaggacagatattaatacattttggtaataaatacatttggtaatcaaggaaagatctgtgagtagaactggattgtctcattcacaaacaaaatactaaaacaatgagatcaatcactcgtttttaagacagaatagaagctaggagtatatttgaaaggcacgtgtgtcctcttgttatactgtctgatattcagcagttaatcatcatccacttcttccccattgccacaagatttggcattctcctaacacatttgcatattataattttaaaaatgtataaagtgcttagtgcaaaacaatattaaaaagcagaatcgaatagtgacaagcacattaatacatcattctttttttttctttttttctcctccctgcccccactactaatatattatttttaaaaattccatatccaggctgggcatggtggctaatgcttgtaatcccagcattttggggggccgaggcaagcggatcacttgagctcagaagtttgagaccagcctggccaacacggtgaaaccctatctctactaaaaatacaaaaactagccgggcgtggtggtatgcacctgtaatcccagctactcaggaggctgaggcagaagaattgcttgaatccaggaggcggaggttgcaatgagccgaaattcgccactgcactccaggccgggtgacagagcgagattctgtctcaaaaaaaaaaaaaaaattaaaaaattccacatccaggctgggcgtggtggctcaggcctgtaatcccagcactttcggaggatgaggcaggaggatcacttgagcctagaagtttgagaccagcctgggcaacagggcaagaccctgtctcaacaaaaaatttaaaaaattagctgggcttggtggcatatgtctatagtcccagctactagggaggctgaggcaggaggatcacttgagcccaagaggtcgaggctgcagtaaaccatgttcgtgccactgtactccagcctgggtgatggagtgacaccctgtatcaaaaaataaataatttttaaaaatccacatccaggccaggcgtggtggctcatgcctgtaatcccagcactttgggaggccgaggcgggcggatcacctgaggctgggagtttgagaccaccctgaccaacatggagaaactccatctcaactaaaaatacaaaattagctgggtatggtggcacatgcctgtaatcccagctactcgggaggctgaggcaggagaatcgcttgaacccgggaggcggaggttgcagtgagccggagatcacgccattgcactccagcctgggcaacaagagcgaaactccatctcaaaaaaaaaaacaaaaaacaaaacaaaaaaaaccacatccagctgtttcaatgttagcaccgacgtttgggacctgagccaaaggatggactgggaaatcttttcccagaatagactactgtcttttttatttttattttgttttgttttttgttagaatagactctactgtcagctgctttagttatacctggtaccaggtatcagtcccagactcccttgtttagacatttcctggtgatattaccacaggctcagggaagataacctaagattaagcttttccactagacacatgacagtaagcttcattaacgggactgacagccccatatgtaacctttttaaggtatcatttacactgtaaaagaaacagtaatattctggacagttatttctagacagttatttctctttttttctttttttttgagacggagtttcgctcttgttgccgaggctggaggctggaatgtaatggcgcaatcttggctcaccacaacctccgccttctgggttcaaccgattctcctgcctcagcctcccgagcagctgggactacaggcatgtgccaccatgcctggctaattttgtatttttagtacacggggtttctccatgttggtcaggctggtctcgaactcccgacctcaggtgatctgcctgggtcggcctcccaaagtgctgggattacaggcatgagccaccgcgcccagcctagacggttatttctgaacagttctagcactggtcgtgctccctatccaatttttaaggatatcctgtggtcttcctactgacatgtgatatgaccaatactttttcctgcccccacctccgaaagtaaattagcttttctgcaagattactcagtgattttggaagatattgttcttttagagaatagccctaaaaaaacaaaattatttccaacggagcttctaactctggatagcttgaaagaagggaggctgaggcaggatgactgcttgagtctaggagtttgaggctgcagtgaactaggacctatgactgagtcactacactccagcctgggcaacagagtgagaccccatctcttgaaaagcaaacaaacaggaagagatatcttgtctacatcttgtctagcatcctgctcctcaccaaaaaaattttaaaagcaaatcatgttgatatctaaaaattctctaagctgtgaaaaagtttcttcaaatgatataccctcttctcattatcctttcctgactctaatgataaacataatagtcaaatagcttagttattcccctaaaattcaatggaacatcgagaaccaagggcaattacaaatgggtaaaagagaataacaggaaaagaaagcaatagactataaaaaagaattacaaggcagagaaaagagtaactctacagtggaaaatcaaatgtatactatttcaaccaggtgatcctggttaatagaaacagtgaaaaatcatgttgacaatggttttttttttcttttttttttgagacagagtcttgctttgttgcccaggctggagggcagtggtgcaatcttggctcactgcaacctctgcctccctggctcaactgattcttgtgcctcagcctcctgggtagctgggattacaggcctgtgtcaccacacctagctaatttttgtattttttagtaaagacagggtttctctatgttggccaggctggtcttgaactcctggcctcgaatgatccacctgccttgacctcccaaagtgctgggattataggcgtgagccaccacaccagccaacaatatgtactcttgatctgatgtgatgagaatggcattatatctccacggtcttcttcccaaaagccataactccagtctaaccataagataaacatccaagttgaagagtggtctataagatacctgaccagtattcctcaaaactgtcaagataatcaaaaacaagttaactcttagaaactgtcacagccaaaaggagcctaaggagacaaaaagcctaaatgtaatgtatcaaggatgggatcttagaacagaaaaaggatgttatgttaaagaaagaaatcagaaaatctgaatagtgtatgcattttagttaataataacgtaccaatattggtttatcattattcaatggcaaaaaccgcaattacttttgcaccaacctaataattgtcacagtgtgctatactaatacaagatgctaacattagggaaactgggtgtcagatatatggaaactctctctgttctattctaaaataaaacactatgttagcacctgaagtcccagcttcttgggggctgaggaaagaggatcacctgaaccccggaggtcaaggctgcagtgagccaacatccgccactgcactccagcttgggagagagagtgaaacccagtctccagaaaaaaaaacaaaagaaaagaagaacgaaaactactcacagcatggcttagtagaaagaacacaaactttagagacaaaatcttgggtttcaatccttgctccatcacttactggctatgtgattttaggtaaattaccaggtgattgtgagctttggtttcctcacttgttgtgtgtgtgtttgtttttgtttttgtttttgagacagagtttcactgttgttgcccaggctggagtgcaatgacacgattctcagctcaccgcaacctctgcctcccagattcaagcaattctcctgcctcagcctcccgagtagctgggattacaggcatgcaccatcacacctggctaattttgtatttttagtagagacggggtttctccatgttggtcaggctggtctcgaactcctgacctcaggtgatccgcccgcctcggcctcccaaagtgctgggattacaggcgtgagccgcaatgccctgcctcggtttcctcatttgtaacatggagataattatagtatcatcctattgagttgatatgaaggttagataatatgcataaagaatctgggcgaaccagcacctcatccctaacaacctctcaaggtccacgtacatctcctgggacagtatgccactcatgactaactgggtttgtaaaaggtggctatttcttttctttttctttttttgtttttttttttttttgagatggagtctcgctctgtcacccaggatgtagtgcagtgacagaacatggttcactgtgacctctgcctcccaggttcaagcaattcttgtgcctcggactcttgagtagcttggactacaggtatggatcaccatgcctggctaattttctttttttctttttctttttctttcttttttttttttgagacggagtctcactctgctgcccaggctggagtgcagtggcaatcttggctcactgtaacctccacctcccgggttcaagcgattctcctgcctcagcctcctgagaagctgggattacaggcgcacatcaccacattcagctgatttttgtattttttattagagacagggtttcacatgctggccaggctgttctcaaactcttgacctcaagtgatcctcctgacctcaagtgatccaccaagtgaagtcacttgacctcaagtgatcctcgactcccaaagtgctgggattacaggtgtgagccaccatgcctggccaaaggtagctatttctacaaagcagccactgagagcacagagtggctatgttgcttcctaatgatagctgaggaatccagtttagcacatcacatactcacctaatttactgtaataacactgagagagctcacatattatacagtaagactgcaagaagatatcatagggctccaggatttcaaaatttagctatgtttagaatcaactgagacattttcttttttttttttttcttttttttgagacagagtctcactctgtcccccaggctggagtgcagtggcgcgatctcggctcactgcaacttctgcctcctgagttcaagtaattctcctgcctcagcctcccaagtaactgggattacaggcgcccaccaccatgcccagctaatttttgtatttttagcagagacggggttttgccacgttggccagggtggtctcgaactcctgatctcaggtgatccacccgcctcggcctcccaaagtgctgtgattacaggtgtgagccactgtgcccggccattttctcttttaaaaaaaaaaaaaatgctgatccatgaccaggtgcagtggctcatgcctaaaatcctagcagtttgggaggccaaggtaggaggacagcttgaggccaggagttcaagaccaacctgggcaacacagtaagaccccatttccatttttaaaaatgctgatcggctgagtgcagtggctcatgcctgtaatcccagcactttgggaggccaaggcgggcagatcacctgaggtcaggagttcgagaccaccctggccaacatggtgaaaccccgtctctactaaaaatacaaaaattagccgggcgtggtggtgggtgcctgtaatcccagctactcaggaagctgaggcaggagaactgcttgaacccaggaggcagaggatgcagtgagctgagatcacaccactgcaggccagcctgggtgacagagtgagactccgtctcaaaaaaaaaaaaaaaatgctgatccaccatcttatccccaactcctgagattaggtgagtctgctatggggccaaggaacccacagtttaggtaagcttctcaggtgatctgaataaaggtgatctgttatccaatttttatgaacagtaattttgtctcttcttctttttacaggaaagaaaattgaggcccagagaatgcaaaaaatgattaaattcagaggcaaataactgagaagtagcaaggccaagaacaggcatctaggttacacatctctatcttcgagtgcatttttctaaaacaaagggcttggacccacaaaccatcacctggaattgcatgtgtgactgaaagggaggaaactgcaaagaaaaagaaaatccttgggaaagacaattctgtggggagaatgtggtgggaaaatcaactgtgctccagtaccagttagtgaaaatgacagactgagctttaaatctttacctggcatttatagactcttctaactgtggcaagtttttttttttttttttttttttgagacagtctcgctctgtcgcccaggctggagtgcagtggcacaatcttggctcactgcaacctccacctcccgggttcaagcaattccctgcctcagcctcccgagtagctgggattacaggcacccaccaccatgcccagctactttttgtatttttagtagacacgggatttcactatcttgaccaggctggtcttgaactcctgacctagtgatccacctgccttggcctcccaaagtgctgggattacaggtgtgagccaccgtgcctggcctgtggcaagttttaaaactgaaatttgttccctttttgcaaatgggtttgggttaatctctaagcagttttgaaaatcagaatactccagttttaatttaaatgtaaaatttctacttgaaaacttctatcttgatttaaagtaaccgaaaaaggcagtatgacttacgttgactctgtattaaacagatgccaaaatcagtctgagtttgaataaagggtaatttatttcagaaacagtggtttaaacattagtctttcaaagcacctgtcccaagaactgctcatttgttttgggaattgaacaaaggctaagtcatacaaatctgattaagaattaaggtgttaccttcagacaatactagaaggtgaaacattcaactttctagaaccatttggcaaagactacaatgtacataattatacattcacaattactggccaggatttccaatggtttctgttctaccctcaattattttacctgagtcataaagcgatcaatagagaacttccaccaggatccactgcatctacccactcaccagcacctgcaatcacatattcccttttgttcatacagatacacaatgttcttatctcaggccaatgtctccatttgattcagtgtttctcactacttgaagatattgctctaacaattctccccctctatccacatcaacttctcccctcaggaagatcattcccatcagcatacatgtatgctataaaatctgtcatcttaaaaaaacgagctgggcgtggcagctcatgcccataatcccagcactttgggaggccaagatgggcagatcacaaggtcaggagttcaagaccagcctggccaagatagtgaaaccccatctctactaaaaatacaaaaaaattaggccaggcgcagggactcatgcctgtaattccagcactttgggaggccaaggcaggaggatcatctgaggtcgggagtttgagaccagcctgaccaacatggagaaaccctgtctctactaaaaaatacaaaattagctgggtgtggtggtacatgcctgtaatcccagctacttgggaggctgaggcgggagaatcgcttgaacccgggaggtggaggttgcggtgagccagagattgcaccactgaactccagcctgggcaacaagagcaaaactctgtctcaaaaaacaaaacaaaacaaaaataaagttagccgggcgtggtggcacgtgcctgtaatcccagctactcaggaggctgaggcaggagaactgcttgaacctagttggcggaggctgcagtgagccgagatcgcacccctgtactccagccccgcgacactgcaagactcatctcaaaaacaaacaaacaaacaaaaaacacaacgaacatctcaattctacatctacctccacttagcacctcagctccttgctctcctttagcaaaattcctcaaaagaaaaaaaaaatcaatgtattgtttatacttaatgcctttaacttctgtcttcccatgctctgttgcccaggctggagtgcaatggtgcaatctcggctcactgcaacctccgcctcctgggttcaagtgattctcctgcctcagcctcctgagtagctgggattataggcaggcgccaccatgcccagctaatttttgtatttttagtagagacggggtttcaccatgttggtcaggttggtctcgaacttctgacctcctgatctgcctgccttggcctcccaaagtactgggattacaggcatgagacaccatgcccatcctgtcttcccattttctaaaatgtattacaaactggcttccatctttatcactcaccccacaagctttctttactaaatttaagggtaattctcagtctttacatgacttgacctcttcgctgcatttgatgcagctgattatttcctcctttcctggaaacgctttcctcatatgctggcttcccagatgccacattctccgatgttctccttccttactgggtgctccttttcgagtcccctgatttccaaatgctggagtctcccagactcaatccttacaccattctcttttttgtttttgttgttctttttgagataggacttgcttcgtcacccagactgcagtgcagtagcgcaaacatgggtcactgcagcctcaacctcctggactcaggtgatcctctcccctcacccctgcccgcctgcatcagccttccgagcagctgggactataggttcacaccacgcccagctaattttttttttaattttttgaggagatggccaggctggtctcaaacccttaggctgaagcaattctgcctcagcctcccaaagtgctgattttacaggcgtgagccaccatgcctggcctttataccatcctctgtcttcactcagtcccttggtaatctcatgcagtctcatagctttaaatccatctggattagtctattctcacagtgctatgaagaaatacccaagactgagtaatttataaaggaaagaggtttaattgactcacagttccgcattgctgggaggcctcaggaaaattacaatcatggcagaagccaaaggagaaacaggcaccttcttcccagggcagcaggacggaatgagtgcaagcaggggaaatgccagacaattatataaccatcaataactcactcactatcatgagaacagcatgggcgaaccacccccatgatccaattacctccacctggtcctgcccttgacacatggggattatgaggattacaatttgaggtgagatttgggtggggacacagggccaaactatattactaactaataggctaatgagccctacatggctacctccagcctgtgtgtctcccctgaactccatatacatatatctccacctggatgtcctaataagcgtctcaaactcaatacgtttcaagtggaatttctcatctctcctgccccttgccaaccttgatcacccagtcttccccatctcagttaatgaaaattccaccctttcaaatgcccaggataaaaacctgaagagtcatcttgattgctttctttctctttcctactctacatccaaaatatgagcaaatccctttggctctatcaaatccacccagttcttaccttttgtgaatactttactccaagtgcctatcattttcagcctagattatgctaccaccttttaactggtctccttgcttccatacttgccctcttctcagaaacctacacaactagccattctattcagtgaatatgacaatgtccttacaacagccagaaagccacacatatgtgatacatccctttcattttctgtccaacctcctctcctttgttcactctgctccagtcacaatggattcctcagtatcccttgactatatcaagcacactcccaactctgggtctttgcactgattattctctgtttgaaacattcgtttctcagatacccacatggctcacttcttgtacccatcaagtccttgttctaatgtcgccttctctctgattctcctagttataatcctcctagccatactgtagtttctcaatagcactttccatcctctaacatactgttatatatttgtcatttttagtatctgtcttccttcatttgaatgtagtctcattagggctgagatgtttgtcagttattgactcatgtgtccctggcatatagaacaataccaggggggcaatccatgaatatttgttacatgaacaagtgaaggatgagagaagaatttaactgaacagaaggactgtagagtcatttattttttattatttttgtagagatgggctcttgctatgttgctcaggctggtcttgaactcaagccatcctggcctcagagtggcctggcctcaagccatcctcccactcagcctcctgaagtgctaggattacaggtgtgagccactgtgcctggcctgtgctgtcatttaagggaagtcaggccctttgttttcagtgtcaaactctcggccaggcacagtggctcatgcctgtaatcccagcactttgggaagccggggcgggtggatcgcctgaggtcaggattaacctcaggtgatgaaaccctgtctctactaaaaatacaacgtgatgaaaccctgtctctattaaaaatagcctggccaacgtgatgaaaccctgtctctactaaaaatacaaaaaattagctgggtgtggtggtgggcgcctgtaatctcagctacttgggaggctgaagcaggagaaccacttgaacccaggagatggagtgagccgagatcatgccattgcactccagcctgggaaacaagagtgaaactctgtctcaaacaaacaataataataggccgggtgcagtggctcaagcgtgtaatcccaggaggccgaggcagacggatcacgaggtcaagagatcgagaccattctggccaacatggtgaaaccccatctctaccaaaaatacaaaaattagctgggcatggtggcacatgcctgtaaccccagctactggggaggctgaggcagaagaatcacttgaacccgggaggtggaggttgcaatgagcccagatcgcaccactgcactccagcctggtgacagagcgagactccatctcaaaaaaaataaaaataaaaataaaaataataataataataataaacaaatgtcaaactctcataacaatgaattactagatactactacttaaacatttaataggaaccaaaaactaacctctcccaaatatttattttccacttcagcaaatggccccaccatcaacgtagctgtataaacctgaaacataagtcacccttgattggccttctcatgctcctaaatctaattcattaagaagtcttggccgggcgcagtggctcatgcctgtaatcccagcactttgggaggccaaggtgggcggatcacttgaggtcaagggttccagaccagcctgggcagtatggtgaaactccacctctactaaatatacaaaaattagcctggtgtggtggcacactgctgtaatcccagctgcctgggaggctgaaacacaagaattgcttgaacccgggaggcagaggctgtagtgagctgagattgcaccatcatactccagcctgggtgatagagtgagactatgtctcaaaaaaaaaaaaaaaaagttttgtcagtttcttactgatatatgctcatctgagtcttgtcaatattgatggccttctgtctagtctggtttactttcttgccttccttcatttcctaaatagaagcaaaatgtgctctaaaatgtaaattgaggcagggaagggcagtggctcatgcctgtaatccagcactttgggaggccaaggcaggaggatcatttgaggctaggagttgaagaccagcccaggcaacatagtgacaccctagttctacaaaaaaaaaagaaagaaaagaaaatgtcccgatgtgggggtgcaaacctgtggctccagctatgcaggaggccgaggtgggaggatcacttgaacccaggggtttgaggctatagtcaattaattatgattgtgccactgcactccagctttggcaagggagcaagattgtctctttaaaaaaaaaaaaaaaagtaatccagatgatgacattcctctcattaaaatctcaaaggtttctgagtccccaccttagtctgtgaataagcttgctcctgtctttatctcaactccccctgtgccactctctcccctgctccttaggctacatccacaaaggtctgctttaagctcctctaacatgtccttttctttgctgcaccaggcacatgccattctcacttccctccactatcattctttaggtctcagccaaaaacaaacaaacaacaacaacaaaaacaaacaaacaaaaagtctcctgtttaaagtaggtctcccctaacagcatgggcaacatagtgagaccccatctctacaaaacaatacaaaaattagccaggcatggtggtgcacgtttgtattcgcagctactcaggaggctaaggcaggaggtcgaggctacagggagctgtgactgtgccattgcactccagcctggatgacagagtaagaccttgtctcaaaaaaaggagctctccccttattctatacttcattccgtttgtttccttcataatttataacaatttgcttacttgcttcttgtttctttcccgttacaatataagctccatgagggcaggggccacaaaagcaggtgtaaatgggaggaggtgttaccttgttggaaatgtctgagaagtactagctgtgggtctcttttagtgtaagatctgtcatcccaacactcgtcaccactctacctccaataccactcttcctccagatggagcacttctatcattttgaaaggaactaaagacaagatttcactgggaaattacattaattccaactggtatagatggaattgtgtcctccaccaaatccatatggtgaagccctaacgccaaggtgatgctatggtggagatgaagcctttggaagacaatgaggtttagatgaggtcatgagggtagccctcataagatgaatccccttataagaagcacaagaagctgggcacagtggctcatgcctgtaatctcagcactctgggaggctgaggtgggtggatcacctgaggtcaggagttcaagaccagcctggccaacatggtgaaactccgtctctactaaaaatacaaaaattagccaggcatggtggcacacacctataattccagctactcgggaggctgaggcaggagaattgctccaacccaggaggcagaggttgcagtgaaccaagatcgcaccactgcactccaacctgggtgacagagtgacaaaaaaaaaaaaagaagcacaagagatgccagagctcactctctgctacatgaaaacacactgagaaggtggcagtctgcaaaccaggagctgggaagagaatcctcactagaagccaacgatgccagattctcatcttgaatttccagcctctagaactgtgagaaatacatttctgctgtttaagctacccagtctatggtattttgtatggcaccctgagctgactaagacaccaaccaataggagaatgctctaatctcataaccacataaccaaatacacatgtaaaaagacatctgatgcagcagtattctctatcaagactctccactcccaaccaaaagtgttccactccttgcttgatgctcttacttctccaacagctacacttttgaagtctgaacactgttaaagcaactattaccttcctgtacatactctgttagaagacaacctcacaactgacagtgccctcccctcagtcaccctccaatctacctacctcgatgcactaaaatgagtgagtcaggtacaccaagacttataaacaactatgttttattcagaaggactaattgacatttcagttaggaagtgattttgattaggactcatgatagcatacagaaacattgtcttagggcatcttacatggggtttctgcctaaatgagaatctcatgggacttttttttttttaatttattattttattttgagacagtctcactccgccacccaggctggggtgctgtggcgcaatcttggctcactgcaacctctgcctcctgggctcaagtgattctcatgcttcaacctcctgagtagctgaggttacaggcacatgccaccatgccctgctaattttttgtctttttagtagagatggggtttcgctatgttggccaggctcgtctggaactcctggcctcaagtgatcctctcacctcagcctctcgaagtgccaggattgtaagcgagagccaccaagcccaggctattttttgagacagggtctccctctttcactcaggctagagtgcagtggagcaatcatcactcactgtagccttgaactcctgggctcaagcaatcctcccacctcaacctctcaagtagctaggactacaggcacatgccatcatgcccggctcatttttaattgttttgtagagacagggtctcactatgttacccaggctggtctcaaattcctggcctcaagagatcctcctgtctcagcctcctaaagtgctgggattagaggagtgagccactgtgcccagccaggactctttattaaacaattgttttttataagtagacatttcaaaaagctcaggttttcctccttctaaaactagcctctaattgcagattaggatgagggagtaactagattctttgagacattttgttagaaaattactttaaacattcaggagtttgtatgttttgtcaaagggaatattccaaatgctctatttttaaaaattcatattccatagagaatgtaaatgattgaagcagttatttctccaatatttctactttgggaatttcaaagcataaccttttctttggcttccctccctcccttcctgccttcctcttttcttcccttcctctctttctctttctttgtttctttttttgagacacagtctcactctcgcctaggcgtctgggcttatatctgtgggctcaagcaatcctcctgtctcaccctcccaagtatctgggactatggaggcatgccaccatgcctggctaattttttgtttttattttttgtagagatgggggtctcaccatgttgcccaggtgagtctcaaactcctggcctcaagggatccttctgccttggcctcctaaagtgctggggttataggcgtgagccacttcgcctagccacaaagcagtctttaaacttgatggtttaaaaaaaaaaagtcttactccatattacagggagaaataagcacagtagttggcagaggctatgaaggtccccaaaccagagctccattttaacaagaaagagcaccacccatgctaaattatcaaaggcataaagcttgtttacaaaataaagacagtaatagtattttgtgactgaaactatcaaagctcctctgaaataagacctgtacaagatcccaagcatggtggcaataggatgcttaagctgagaagatcttctatattttagaatccataactcagctgagactgcagtaagctgtgactgtgctactgtactccagcctgggtgacaaagcaagatcttgtctcaaaaaacaatacaaaacaaaacagaagctgtaactccaaatattaatcaatttgcactaagtgcaatatggtataaagggctagaaaaggttattctccaaagtacaaaattctcagggccctgaaatagttctagctatcaaactttttatatgattaccatttctttattattccaatagtttttgtggagacttgctctgttgcccaggatggagtgcaacctccacctcctgggttcatgagattctcctgcctcagcctcccaagtaggtgggattacaggtacccatcaccatgcccagctaatttttgtatttttaggagagacagggtttcatcatgttggccaggctggtctcgaactcctgacctcaggtgatccgcccgccttggcctcccaaagtgctgggattacaggcgtgagccagtgggcctggcttgtaggtttgtttttgtttttgttttttatgaatggcacaaacggcctttattggttgtgacaggaagtggaagagaaggggatataatagctcctcctcctggtgtggccatctgcagactggaccaccaccctcctaccctccaaatgccaataattttaataaagaacttcatctacacaaagcccagctccacccatggtatccactcagtaggctcctcctatatttgcctaatgtaggtggaaagaacaggaacttaagttttagggaagcaaaatgcagcttcttctcataaacaggtttaagtccctggcctagacattcacagtagcggttatagaaagggaaacataaactagcctttttagcccatttaaaaatagtcatttagtactactccacatttctcccagagaagtgcaataacttatttatagttacatggagaattggtgactatgccaggaaatgaaactcatgtcccctcactcttagtccagtgccctttctaatatacaatgatgcctcctatctggtaatcaaagtagtaaggcaaggcctaaataaataaggaacttgcccaatggaaacccaaatgtccttagtcctaagactgagtcctaatactaaaaagccaaatgaatgttttgggaaaagcttgccaaaaaatctagcagaatactttatactcagtggacactatttctccatcacaccaacccctccaatctatgcctcctcaaattgccctgcctcatgagtgcaaaaaccattgtttttattttttcccccaggagaggttaggtcaaaaataagaaaataatctagtttctttctgccagatttctggcatagtgggactgggtaggaatgtacctactgtagaatcttcccacacccctgggttgttaagagtaactagcagaggcacgtcccatacactccccaaatatctgagctggcaacaacaacagatattcagagaccttagccctaggacaatagcttctgtcagtcaactacagttctcacgactctgtgtttctgttcttacttcaacctcctaccaaatgatgtatcacacctgtatgagtatacttgagaaaaccatgcaaatgaattcacacagcagtacagcaattttggcagggcaccattactaatgataaagtataatttaacaaaaaacaaagacttacacaagcatattactattatcatttacatggcacattaaacttaaggacctgagtcccagtaacccatccttgagaccaacaccaaaaatgatcaggtagagtttccatgccaagggagtcacctggtaaggaggcaaagatcagcatttcatctcttacctgaagccaaaggtcggatccactctttgctgtttaggtcaagtctccagaggtcattgaaagcagcattgcagctgctctgggtacagcctccaaacacatacatagactgattagcatcataatagcatgcacctagaaagaaaatacacaaataactgctgtgaaaattctgaggcccttccaacattttaaccataacatatatttttcaaagcttatttcacacattcagcaattttgttaccaagtaccaaatttctattaccagcctcttgtctccaagtggatcaatatattaccctttaaaacaaggtccagaggaaagctatgaaaattttatttctgagcacactaagcaagttgacaatgatgtaacagtgtaagtccagcaagaacacataataattcacattaaaggtgctcaaatgagggaaatttcagcacagctacataattgatctaaatctgcatcattatcctctagagctaagcaaaggtatgccaacacatgtactctgtcctcccattcctttcctccaattctcctattgtttttgttttcaaattaaacctgaagcacaaatcaataaatgaatcttttttttttctttctttctttttttgagatggagtctccctctgtcagccaggctggagtgcagtggcatgatctcggctcactgcaacatctgcctcccaggtgcaagcgattctcctgcctcagcctcccaagtagctgggattacaggtgtgcaccaccacacccagctaatttttttgtatttttagtagagatggagtttcaccatgttggccaggctaatctcgaactcctgacctcaggtgatccacccgcctcggcctctcaaagtgctgggattacaggcatgagccaccatgcccggccaataaatgaatctttatatgacacacaatgaaatgattttaatcaatactatgaagtaaccacacataaagtccaatgtgattgaagaaatacagtttttattaattccaaaggccagtgggggaaactcaatagtagtatggtcttggactagtcccaaagcaacagattgaaaaagcatggaaatcattaagtcccaatatgtatccaagagctaccaaggcatgctggttggagccgactagaaaacagaacggtaacatttaaaaaacaccaggatctctaaaaaaagccttctttgattagatgattgtatacacatcaccaggcattcctaagaaaaagaggcaatgactatcagaagggctgttacccaaaaactacaaagaccaaagccagagtctagaaaagatgcatgagtgctaagttctgccccttgcggtctctatcctttggaaatgacgatcacattccttacagtcttgcatttgccatcttggatttcaggaagaggcccaagcaaagctttccttgccatccatttcatgcacgcaggaggtaaaaataaaataaaataaaattaagtaaacaaaaaagacttctcaatgttcatgtgaaactaacggttcagtgtcatataaaaggaaggggaaaggaaaaagaaattcacagattcaggccaggtgcagtggctcatgcctgtaatcccaacactttgggaggctgaggcaggcggatcatgaggtcaggagttcgagaccagcctggccaacatggcaaaaccccgtctctactaaaaataaaaaaattagccaggcgtggtggcgcatgcctgtaatcccagctactcaggaggctgaggcaggagaatcgcttgaacccgggaggcggaggttgcagtgagccaagattgcgccactgcactccagcctggacgacagagcaagactccatctcaaaaaaaaaaaaaaaaaaacaaaaacaaaaaacaccaacaagaaattcacagattcattgccctgtgcatggctttaatgatcatctagcatatttgtaggtctaattcagtttagcacaccaatatttttaaggtctcttctgaactctggcactagttacccgagttcagaaaaagggaaatgctactactgttgactcatccaatgccactactataatcacctctgtgatacacactatactagctctgggaataaactcccccctcccccgcaccccccaccccccgctttttgttttttttgagacagagtcttgctgtgtggccgaggctggagtccagtgccacaatcttggctcactgcaacctccacctgccagcttcaagcaattcttctgcctcagtctcccgagtaggtgtaactgggattacaagcacacaccaccacacccagttaatttttgtattttagtgaagacagggtttcaccgtgttggccaagctggtctcgaactcctgacctcaggtgatccacccgcctcagcctcccaaagtgttgggattataggtgagagccaatgcgcccagccccccaccttcttttattttcccttaattcagccctcctgttagacccctgggactctctacggtaagaaggccaagtcagaaaactgagcaagttaagaggtaatgaaagcagtatgtttagtgccttaaaccccataatctcagtcagtggaagggttaaatccaaattatctgacctctgacactgtggaataatggagctgcaggcttttaaaattaccaaagaaattagacaaaacagatctgaagaaataaaataccatctagccatcaataggctcacacctgcaaaatatttatggtatccccagaactctactaagaagtcaagtccaggccgggcgtggtggctcacgccagtaatcccagcactttgggaggccgaggcaggcagatcatgaagtcagcagatcgagaccatcctggctaacacagtggaaaccccatctctactaaacatacaaaaaaaaaaattagccgggcgtggtggcaggcgcctgtagttccagttactcaggaggctgaggcaagagactggcatgaacccgggaggcggagcttgcagtgagccaagatcccgccaccgcactccagcctgggcgacagagtgagactccatctcaaaaaaaaaaaaaaaaaaagtcaagtccaatgaatccatggctcacatgtcagatctgttaagaactacaaataacaggctgggcacagtggctcatgcctgtaatcccagcactttgggaggctgaggcgggtggatcacttgaggtcaggagttcgagtccagcctggcaaacatggtgaaacccctctctactaaaaatacaaaaattggtctggcatggtggcatgcacctgtaactcccagctactggggaggctgaggcagtagaatcgctcgaacccgggaggtggaggttgcagcgagctgagattgcgccactgcaccccagcctgggcgatagagcaagactctgtctcaaaaaacaaaaacaaaaacaccaaagaactacaaataacaaaggatcaagttagaagacattagacaaacaaaaggacaattactggagccacattttaatctccactaaaggagctcaactccagatatcctggtcctcttagacatatcttgacctagtaatcctaaaaaatggggcaattttgaaatgagccaactggtaccaggttggctcagtaaaagcacattcttctcctcttgatattccagacctccagaaaaagaaattagcaatgtcctatgagttatttatttattttctgagatggagtctcactctgtcacccaggctggagtgcagtggcacaatcttggctcactgcaacctccgcctcctaggttcaagtgattctcctgcctcagcctcccaagtagctggaattacaggcgcccaccaccacgcccagctagtttttgtatttttagtagatatggggttccactatgttggccaggctggtctcgaattcctgacctcaggtgatccgctcgcctcggcctcccaaagtgctgagattataggcgtgagccaccgcgcccggccaatgtcctatgacttctgaaaccttaactagtgtccattataacattgcttaataaaacaaatccatgatttcataactaaaagagtcaagggtttgttacgtctcccagttcctcacagataacttcttggcagctgcttccttagtgtagcaaaagaacacagtgcctgtatttttcaaaaaggtaacaaacatttttcctttttaattttttttcctcgagacagagtcttgctctgtcacccaggctggagtgaaatggtacaatcttggctcactgcaacctctgcctcctaggttcaagcaattctcctcctcagcctcccgagtagctgggattacaggcatgtgccaccatgcctggctaattttttgtatttttagtagagacggggtttcaccatgttggccaggctggtctcgatctcctgacctcgtgatccgcccgcctcggcctcccaaagtgctgggattacaggcacgagccaccgcacccagcccacatttttcttctctatttggactgaaaacccagccaacagcggggccctgaggtccttaccacatgtattttaatcccacactaaaatagggcaattggcattttcctgcttctcttgagcaaacaaaggtttctggaagaggaaggcacagcccaaagtatgcaaagctaatggcactaaaatggcaagtttcacacactactgtattttcagtgaccagcagtcaattatcaacaaagttgggagaggaagggagtcagtttaggcagctatatttagaactcagatataatggaatgagaaaataactatcaataatacgcttaattattattattattatttttttgagatggagtctcgctctgtcacccaggctggagtgcagtggcacgatctcggctcactgcaacctccgcctcctgggttcaagcgattttcctgcctcagcctcccgagtagtttggaccacaggcacgcgctaccatgcccagctaatatttgtatttttggtagagatggagtttcaccatgttggccaggatggtctcaatctcttgatctcgtgattcacctgccttggcctcccaaagtgctgggattacaggcgtgagccaccatgcccggccacactcaactattttaagcaccctagcctactgaactttacttattgcctattttttatttaagacacctatagattgatctgagaggggcaggggcagggaggaagacccaacaagttcaaatgaaccttttaggaaaaagaatttgagcaactcccagtgctccagtagtaatttcccttttcacaagttctcaacctaaatagaaaattttcctttcagaacatctagaccactagaatgtgctatacagttacagctcacagtacagtatgaatactgggctaacaaataatactgagagtgtctattccaactggtaaatctcttcaagttttctgaaatgggcttagtttacgacacatactaatcatccctattaaaatacaagtcaaatagtcacaatttaattacacacagagcaagcaaacagttcttcacagttctgaatacttctccactattctataatcatctcaagtgcaagatcttccagtagtttcatcttttccatggtgtatggagcattcaataaatgctcactaaatgaatgatatgcttttgcattttcagacgtcaaattctcttttgtttcttcacctgtctccagggaaagatcctgaggcatttatcccatgcttaaagagactatgctgtcatgtgtctcacacctacaagccagaacatatttgataaggtctctaattacgtaactatgaagaagcaagggcggttatccagtctgggcctgctggctcctgcaggagcatgatgagcattgtgtatgaaactacctgactatatgtgacacctacaacactgaaacatttttcaatgcatgatgttggggactcaggagaccccctacatcaatctgaaaaggacattctacattaattaaagcttgcatgattagctatgcacacattcaccaaaaagctagaattggcctttttttttttttttttttttttgagacagagtgttgttctgtcacccaggctagagtgcagtggcataatcttggctcactgcaacctctgcctcccaggttcaagcgattctcctgcctcagcctcccgagtagctggattacaggcgtgcgcccaccacgcccagctaatttttgtatgtttagtggagatagggtttcacgatgttggccaggctggtctccaactcctggcctgaagtgatccacctgccttggcctcccaaagtgttgggattacaggggtgagcctctgcacctggccctagaattggcctttttacttcacctgacttttttgtcccagacttttccataggaaagatactatactgtgcatacctttgttgcacttaagtccacaaaaattattaggtatcaaaatatattgataccaaatttattagatatcaactatgaacaaggtgttgtgaaacagtacaagaaggctgggtgcggtggctcacacctgcaatcccagcactttgggaggctgagatgggcagatttcttgagcccaggagtttgagaccagactgggcaatagggcgaaaccccgtctctactaaaactacaaaaattagctgcgcgtggtggcaggcacctgtaatcccagctacttgggaggctgaggcaagagaatagcttaaatctgggaggcagaggctgcagtgagccaagaccgcgccactgcactccagcctgggtgcttgggtgacagagtgagaccccatctcaaaaaaaaaaaaacaacaaaaaaaaaagaaacggtacaagaatgtctaagacatggagcctgtctatcttcaagtagacgacaatcttgtgggggagacatcatcatcatcctacttttttacagcttaaaatatatacatatattttaattttaaatagagatgttgcccaaattggtctcaaacacctgggctcaagtcattctcctgcctcgactttaaaacatatttttacaagtgttttcttaaatgcatttctcagcaatctatggcacaaacagaatttgtcatatccatttttcagacaaagaaactgtgggtcagacaagccaagaaacttgcttcccacatccaaaggcctttcctttttagcatgcagcctctctcacacagataataatggcaaaagacagatggtaataaataatggaggaaggtatgaatagtatattagggaagcagagaggaagaaaagagcttaatatctacggcgaggaatctgagagaagttggtaaaaaatgtggcttttgattttatctttgagatgacttttagagaacaggacactttcagtccattaagaagggcaggccgggtgcggtagctcaacgcctgtaatctaggcacttagcaagactgaggtagtgtattagtccattttcacactgctataaagaactatccaagactgggtaatttataaaggaaagaggtttaactgactcacagttccacatggctggagaggcctcaggaaacttacatttatggtagaaggcaaaggagaatcaagcaacttcttacaaagcagcaggagaaagagcacaggggaaactgccacctttttttcttttttgaaacggagtctcgctctgttgcccaggctgtagtgcagtggtgcaatctcagctcactgcaacctgcaccacaggggttcaagcaactctcctgcctcagcctcccaagtagctgggactataggcacccgccaccaggcccggctaatttttgtatttttagtagagacggggtttcaccatgttggccaggctggtttcaaactcctgacctcaagtgatccgccctcctcagcctcccaaagtgctgggattacaggcgtaagccactgcggccagccgaaaccgccacttttaaaccatcagatctcatgaaaattctttcactataacaagaacagcatggaggaaaccgcccccatgatccagtctcctcccaccaggtcactcccttgacacatggggattaccactggaggagatgagatttgggtggggacacagagccaaaccatatctggcgggcacactgcttgagctcaggggttcgagaccagtctggacaacatggcaaaacacaattaaaaatttcaaaaactaattcaaaaaagaaaaaaagggaagggcaaataaggaagtttaagacataacaaggaggttcatgtggctgaagtctggctacctaaggatgcagcagtgagtcaggctgaaaaggcaagccaggtccttgaaaggcaggcagaatgaaaactcctacatgcagcacactaacgctgaagcttgctgacggaagaatgcaaggctagttgcatgtttcagacttgcagtatttcccaacaggagctcttatcatttggggcaggataatctttttatctgtaggactgtcctatgcactgcaggatgctgcacatccctgccccttgcctacttcatgtttatactgcttttcagtgatgacagtaagcaatgactttacagatttcttacagatttccgaatgtcagaggaggaggagatactgtccccagttttagaggtggttattaatggtctttagtccaggttcacatgaagagagaagaaaggcaagaagataattttttttttttttttgagacagagtttcgctcttgttgcctaggctggagtacagtggcatgatctcgactcactgcaacctccgcctcccgggttcaagtgattctcctgcctcagcctcctgagtagctgggattacaggtgcctgccaccatacctggctaattgtttatatttttattttatttatttttgagacggagtctcactctgtcaccgaggctagagtgcagtggcgtgatctcggctcactgccagctccaccccctggattcacgccattctcctgcttcagcctccccagtagctgcgactacaggcgcccgccaccatgcccgggtaattttttatatatatatttttttaagagacggggtttcaccgtgttagccaagatggaattgttcatatttttagcagagacggggttgtaccatgttggctatgctgttctcaaactcctgacctcaggtgatccgcccgccttggcctcccaaagtgctgggattagaggcgtgagccacagcacccagccaaatttgtattttttttttttttttttctgagatggagtttcactcttgttgcccaggctggagtgcaatggtgcaatctcggctcactgcaacctccgcctcccaggttcaagcagttctcctgtctcagcctcccaaatagctgggattactggcatgtgccaccatggctggttaatttttttttctatttttagtggacagggtttcaccatgttggccaggctggtctcaaactcctgacctcaggtgatcagccaacttcagcctcccaaagtgctgggattacaagcgtgagccactgaacccagcccaaatttgaattttataatcgacacttgtcacattcaaaatttttgtaggagtccatttaaattttgtgtttgctgaacatgtattatgttaaatagccattatatgacctagtactaaaatctgactactccctaagcaaaatcttagaaataccctcatgtacagctttcctttgttttcctcttagataatgtcagatgtttaaaacgctaagcataacaccttgaccactctggagtagagaaaaatccaatgaaaaagcagagggctgggcgcggtggctcacacctgtaatcccagcactttgggaggccgaggtgggtggatcacctgaggtcaggagttcgagaccagcctggccaacatggcgaaaccctatctctactaaaaatacaaaaattagccaggtgtggtggcacacaccagtagtcccagctactcaggaggctgaggcaggagaatcatttgaacccaagaggtggaggttgcggtgagccaagattgcaccactgcaatccaccctgggcaacagagactctgtctcaaaaaaaagaaaaagcagaatataaaattcttaacaaactgcctacaatatatttaggctgacacttttccctaattctggttataaaattaatataaactctcattttacattctcttcattaaaaagtcagataatggccaggcacagtggctcacacttgtaatcccaacattttggaaggccaaggtgggaggatcgcttgagcccaggagttgaagacaagcctgggcaatacagtgagaccccatctctacaaataattttttaaaaattagccaggcgtggtggcatgcacctgtgggcccagctactcgggaggctgaggcagaaggactgcctgagccgaggaggtcgaggctgcagtgacccatgatcacaccaccatatcacagcctgggtgacagagtgagactccatttcaaaataaataaataaataattaaaagtcggataaaatacatgccttggctgggtgtcgtggctcacgttatgtaatcccagcactctgggaggccaaggcaggcctattgcttgagctcagttcaagactagactgggcaacatggtgaaaccccatctctacaaaaaatacaaaagttaaccaggtgtgatggggcacgcctgtagtcctcatactcaggaggctgaggtgggaggatcacctgagcctggggaggtggaggctgtagtaagctgtgattatgccactgcactccagcttgggtgatagagtgagaccttgtctcaaaaacaaacaaaaaaacatgccaccaaacaagtttctggaaatatgaccacaggcagggtggaatctgctttcacagtaaatacttactgtgcgagaagcgctgagtgattggggttccaggataaggataggtacggctctcccactgaatgtttccttcctggacagccttcatgaaaccatgataacactgatgggctacacctaagacagaaagagcaaacccttcagtccagacacttaacttatccatcaaattattaaaactgtgtctattacctgtttttatcatttttatacaagtttcttttttttttctttttttgagatggagtctcactctgtcgcccaggttggagtgcagtggcacgatctcggccactgcaacctctgcctcctgggttcaagtgattctcctgcttcagcctcccgagtagctgggattacaggtacctgccaccatgcccagctaattttatttttagtagagatggggtttcaccatcttggccaggctggtcttgaactcctgacctcgtgatccacctgcctcggccttccaaagtgctgagattacaggcatgagccaccgcgcccagcctataagacaagtttctttgaggaattccaaatttatctgattttcattcaaagaaaggaaatacaattttaaaactgaaaggcaatccttccattttatcaaagttcatggaggttaggtgacattaaaaattacaaaattagctcacactgtaactctagtcccttttattttatctcataaggcaacatatcaagatcattgatattatttactccaaagcaaaggtgttgggggataatttagccttatgaaagagtatgataaaacaatgtctagaacataacaggtgttcagtaaatatctatagttggaaactataataaagcattctctgtcttaaatatggagataataattagtttacaattgattatgttttgtttatttatttttttctttagacagggtctcgctctgctacccaggctgcagtggcatgcatgactttagctcactgcaatctctgcctcccaggctcaagcaatactcctacctctgcctcctgggtagcaggcactacaggcaaacaccaccatgcctggctaaaatggattatgaaatacataactcaggaaagtttgttttctttttttttctttttgagacagagtctcgctctgttgcctaggctggagtgtagtggctcactgcaacctctgcctcccaggttcaagtgattctcctgcctcagcctcctcagtagctgggattacagacatgcatcaccatgcccagctaatttttgtatttttagtagagacagggtttcaccacagtggccaggctggtctcgaactccccacctcaggcgatccacccgcctaagcctcccaaaatgttgggactacaggtatgagctaccatgcccaaccaggaaaagttttctaaaagatgagaggccaggcgcagtggctcacacctgtaatcccagtgctttaggaagccaaagcagaaggatagcttgaagccaggagtttgagaccagcccgggcaacatagcaagaccccatttctctgcaaaaaaattaaaaattagccaggcatggtggtctgcacttgtagtcctagctacttgggaggcagaggagggaggatcacctgtgcccaggagttcaaggcagcagtgatcatgcctatgatcatgccatgccactgcactccagcctgggcaagacagtgagaccctgtctcttaaaaaacaagcaaaaaaaaaaaagacgaacatataacaatggagaggaattgattatggaatcataacctgtcttggtcctagagctaataagcaagattgcaggatacaaggttagcatacaacaatgaacaagtagaatttgaaattaaaacacataatttgaaattaaaacacatatacattcgcaccaaaaaatgaaatacttagatataacaaaatacatacaaaatctatatgaggaaacccataaaactatgatgaaagaaatcaaagaactaaataaagagatagtccatgttcatggataggataagaagactcaatattgtcaagatgtcagttcttcccaacttgatcaacagattcaatgcaatcctagtcaaaaccccagcaaattattttgtgaatatcgacaaactgtttccacagtttatgtggagaagcacaagacccagaatagccaagaaaacatggaaggaggagaacaaagtcagaagattgataccacctgacttcaagacttactataaaagctacagtaatcaagacagtgtggtatttgcaaataataaacaaataaatcaatggaacagaatagagagccaagaaatagacccatacaaatacagtccattcatttttttttaatagaggtggggtctcactatattgtccagactggtctcaaactcctgagctcaagtgttcctcccatctcagcctctcaaagtgttggaattacaggcgtgagccactgtgtccagcctttactgatctttgacaaagaagcaaaagtaatgcaatgcagaaaagacagccttttgccaggctcagtggtgtatgcctgtggtcctagctacatgagaagcaaggcaggaggatcgcttgagcccaggagttcgaggctgtagtgcacaatgatcccacttgtgaacagccattgaatttcagcctgggaaacacagtgagacccatctctctttttttttttttttttttcctttagactgagtctcactctgtcacctaggatggagtgcagtggcacgatccccgttcaccacaatctctgcctcctgagcacaagggatccttccacctcagcctccaagtagctgggactacaggcacacaccactgcactcagctaatttctgtttttttgtttgtttgtttcatagagatggaggttgaccatgttctcaggctgggagaccccatctctgttttttttttttttttttttttgagaaggagtctcactctgctgcccaggctggagtgcgtggtgcaatgtcagctgactgcaacctccacctcccaggttcaaatgatttccctgcctcaggttcccaagtagctgagattacaggcatgtgccaccatgcctagctaattttgcatttttagtagagacggggtttcaccatgttggccaagctggtctcaaactcctgatctcaagtgatccgcccacctcggcctcccaaaatgctgggattacaggcgtgagccaccatgccaggccgggagaccccatctcttttttttttttttttttttttttttttgagacagagtgtcactctgtcacctaggctggagtgctgtggcgcgatcttggcttactgcaacctccaactcccagattcaagcgattctcctgcctcagacttccaagtagctgggattacaggcacgcgccaccatacccagctaattttttttttctttttgtatttttagtagagatggggtttcaccacgttggccaggatggtctcaatctcttgacctcatgatccacccaccttggcctcccaaagtgctgggattataggcatgagccaccgcgcctggccaaccccatctcttaaagaaaaaaaccttttccaaaaatgatgctgaaataaattaaaatctacatgcaagaaaatgaatctagacatcttccatgaaaatgaactaaaaatgaatcacaatcctaaatgtaaaacataaaactcctcgaagataacaggagaaaatctagaagaccttgactttggggatgactttttatacacagtaccaaaggcatgatccatgaaagaaagaatggccaggcatggtagctcacgcctgtaatcccaacactttgggaggccaaggtgggaggataacttgagcccaggagttcaagaccagcctgggcaacacaaggagaccctgtctcgacaaagtattttttaaaacattagccgggtgtggccgggtgcagtggctcacacctgtaatccgagcattttgggaggccgaggtgggtgatcacttgaagtcaggagtttgagaccagcctggtcaacatggtaaaacctactctactaaaaaaggttttgttcttactaaaaacaaaaattggccgagcgcagtggctcacgcctgtaatcccagcactttgggaggccaaggcaggcagatcacaaggtcaggagatcgagaccatcctggctaacacagtgaaaccccgtctctactaaaaatagaaaaaattagccgggtgtggtggtggatgcctgtagtcccagctactcgggaggctgaggcaggagaatggcgtgaacccgggagaggagcttgcagtgagccgagatcacaccactgcactccagcctgggcaacagagcaagactccatctcaaaaaaaaaaaaaaaaaattagccgggcgtagtagcatgcacctgtaatcccagctacttgggaggtggaagcaggagaattccttgaacccaggaggtggaggttgcaatgagctgagactgcgccactgaactccagcctgggtgatggagtgaggttccatctgaaaaaaaaaaagaaaaacaaattagctgggtatggtggcatgtgcttgtagtgccagctatttgggaagctgaatttggaggattgcttgagcctgggaggttgagtctgcagtgagccctgatcacgccactagactccagcgtgggtgacaaagcaagaccttatcccctccccaaaataactgataagccagaattcattaaaactaaaagtttctgctctgtgaaaaatactgtcaagggaatgagaagataagccacagactgagagaaagtatttgcaaaagacatatctgataaaagacagttatatagaatatccaaagaactcttaaaactcaacaatattagggccaggcgcggtggctcacgtctgtaatcctagcactttgggcaggtgctcaaataaattaaatattatttatttatttatttggtggatcacttgacatcaggagttcaagaccagcctggccaacacagtgaaaccctgtctctgctaaaaatacaaaaattgccaggaaattgcttgaacccagaaggtggaggttgcagtgagccaatattgtgccactgcactccagcctgggcaacagagccggactccatctcaaaacaaacaaacaaacaaacaaaaaaactcaacattaataaacaaacaacccaattaaaaaatgggtcaacgccgggcacggtggctcacgcctgtaatcccaacactttggggaatggcatgaacccaggaggcggagcttgcaataagccgagatcgcgcccctgcactccagcctgggcgacagagtgagactccgtctcaaaaaaaaaaaaagggggtcaaaggcctggcatggtggctcataatcccaggactttagcaggcccaggtggtaagattgcttgagcccaagagttcaggaccagcatgagcaacacagtgagaccccatctctacaaaaataaataaataaatacaaaaattagctgggtgtggtggtacacacttgtagtcccagccacttgggaggctgaggcgagaggattgcttgagtccaggaagtcaaggccgcaatgagctatgaccatgccactgtgctccaacatgggtgacagagcaagatcttgtctcaaaaaaaaaaaaaaaaatatatatatatatatatatatatacatatgtatatataaaataaaaaatgggtcaaagacctgaaacagacacttcaccaaagaaggtatgtgggtaacacataagcgcatgaaaatacgctccatatcatttgtcatcagggaaatgcaaattaaaatgagataccactacacatctatgagaatgatgaaaattccaactactactacaaatgctggtgagaatgtggagcaaaaggaactctcattcactgctagtgggagtacaaaatggttcagccacttaaaacagtttggcagttccttacaaaactaacgatgctcttaccatatgatccagcaattgtgcatcttggtatttatttacccaaaggagctgaaaacttatgtccacagaaacacctgcacatggatgcttacaccagctttattaataattgtaaaatcttggaagcaactaagatgccctttcagtaagtgaatgggtaaacaaactgtggtgcatctagacatgaaatattactcagcactaacaaaaaaaaagctaagaaatcatgaaaagaaatggaggaagccgggcacggtggctcacacctgtaatcccagcatttttggaagctgaggcaggaaaatcatttgagcttaggagtttcacaccagtctaggtaacagcaagatcctgtctctataaacatttttttaaaaaaattacacaggcatggtggtgcacacctgtggtcccagctattctggtggctgaggagggaagatgacttgagcccgggagacggaggttgcagtgagccaaaatcgcaccaatgcactccagcctgggcaacagagcatgactctgtctcaaaaaataaggaggaaacttaaatgcaaatattactaagtgaaagaaaccaatcggaaaaggctgtatactgtatgattccaactatatgaccttctagaaaaggcaaaactatggagacagtaaaaaaatcagtgattgccagtggttggtggaaggaaaggataaacagggagagtatacaggatttttagggcagtgaagctattatgatattataacagtggatatgtgtcattatacattcatccaaacccatagaatgcacaacaccaagcatgaacattaatgtaaactatggaatttgggtttatggaatgtttcagtataggttcatcaattttaacacatgtaccactctggtgggggatgttgataatgggagaggctatacatgtgtcagggtaggggatatatgagaaatcggttttgttttgcttttttttttttttgagacagaatctctgtctgtcatccagactcgagtgcagtggctcgatcttggcacactgcaacctctgcctcccaggtttgaacgtttctcctgcctcagcctcccgagtagctaggactacaggcacccaccaccatgcctcactaatttttgtatttttagtagagatgaggtttcaccatgttgaccaggctggtcttgaactcttgatctcaggcgatccgcccacgttggcctcccaaagtgctgggattacaggcgtgttccactgtgtccgctcagaggaatttgtttctcctactcaattttgctgtgaacctaaaagtgctctttaaaaaaaaagtctactaaaattaaaaacaaacaaacaaaactatcttgtcagtgacttctgccagaaagatcgatctaagattgtgagtactagggtagggttcttctctaaataaaaataaaaaaaaaagaaagaaaagaagaaagagagagaaagaaagaaagagaaaagaaaacaaagaaagaaagaaagaaagaaagaaagaaagaaagaaagaaagaaagagaaaagaaagaaaaccaaaataagactgccaaagaaaacctaaggataaattcatatatttgattaaatcacagtcccttacctgtggttttcctccctttatttgagaagtgaaaccatgtatttccacattgcagggagccaatctctcctgaagagcccatcaactcagaatatagaagcaggctgtgtgtgccagtattggcagttataatcaaatgagcacagggccaacagagcagtttcaatacagctggttcttagccctctaggtggactttgggagttgacaaggactccatgagaaccaccttgatgcaaggaaaacattttaaaactgattgattttgatctaaagattgttctctgttatatctctggctgccttgttcccccaggaaagaacacattgagacaaccctcgcttgataaaaaatgactccacttgattgatcatcttcaaacaaaaaatgggccctttccacttaagatgcaatgaagccactaactgctttctgctaattaaaaatacagcatgtctagcacctaaacatttagcaaaaagttgaaatcttgattaggaaaaggatgaaaaaaaggaccagagtcttgctctgtcgcccaggctggagtccagtggcgtgatcttggctcactgcaacctctgcctcctgggttcaagcaattctcttgcctcagcctcccgagtagctgggattaggtgcccaccaccacacctggcttatttttgtatttttagtagagacagggtttcaccatgttggccaggctggtctcgaacttgacctcaggtgacccacctgccttggcctcgcaaagtgctgggattactggtgtgagccaccacacccggccaagaaacatattttaaaaagtaaaagatgtatatagggtctttgctgtttagagataaaatcaagtgacaaatgttttcaagaaagcagttgctaaaagtagctactcagagacaatctgtagccttaataagagcatggactttaaagccagatcgcctgaacgtgaatctttaatcctgcatttactatccgtgtaaataagttaactgtgtttcactcagttctgtcatctataaaatgcaggatcttctagtcagagtttgctgtgagaatgtaaagcagttacaatagtgcttgacacgtgataaaagctatgttcacattggctattactattatcccatatccatttctattttgcccattcaagaacaatacaattaatccatttgggacgctgaggcgggcggatcacgaggtcaggagattgagactattctggctaacacagtgaaaccccgtctctagtaaaaatacaaaaaatcagccgggcgtggtggcaggcgcctgtagtcccagctactctggaggctgaggcaggtgaataacatgaccccgggaggcagagcttgcagtgagccgagattgcgccactgcactccagcctgggcgacagagtgagactccgtctgaaaaaaaaaaaaagaaaagaacaatacaattaaccagatcaactctaagaatatgaagcttttaaaaacaatcctcattttaaaatgcaaatgggattagatacttcagtattcaagctgttcattaaactaaccagggtaagaaagaaaaccgggtagtatcgtctaatgctagattttataaccataatacatttaagggaggaaaaaaactaaatttggagtctaaaaataaatcagtgaaatttgaaatcaataaataaacctttctcctatccacagtacctttgataagtcgataccactgtttgcagacaagggccgcagttttgtgttcctgatacggtgagagaaaggacaggatatactccaaaacctcttctggcagctccgacatggacctattatgtctagtctcctcagcctccaatactgggtggggctcctcatcttgatccattgtcccttccagcacagtttcttcctggtccacagccatgaaactgtcatcttcactgtccgaggagctggccatgacattccactcaacagctgtaataggtaaaacataaatatcagtattccactgaaagcagctcaaaaacaattcaggcatgtacatccaagctctttgtaatttcgtttccactctcagtgtgaaatctgctcttcagcactttccaataccacttgtgagccaccttaattcgacaggtacagctcaaataccaagcccatccccaaaggcttttgattacattttttctcttcactgaaaaccagagtggcagccaagttctggtataatcgtaaaccagaaaacttgttctccaacaattcttctaactcaaggatctgactgaccgacagcaaagggaagagcaactagcctccttggccagtaacaatgatctaagacctcaaattttgaaggaaaaactaactctgggtcttgcaaaaagtaataacattctgagaatatgggttaagaaataaccgtttttcgaccaggcatggtggctcaaacctgtaatcccagcactttgggagaccgaggcgggcagatcacctgaagttgggagtttgagaccagcctgacaaacatggagaaaccccgtctctactaaaaattgaaaattagctgggcatggtggcacatgcctgtaatcccagctactcgggaggctgaggcaggagaatcacttgaacctgggaggcagagttgcagtgagccgagatcatgccactgcactccagcctgggcaacaagagcaaacctccatctcaaaaaaaaaaaaaaaaaagaaagaaagaaaagaaagaacagtttttctaaacttttatgcaagacgattcacttaacctttttcctgtttgcccggagaatacttgccagcggtgcctgcaactgtggtgtttaccccgagataactttgccacaaaatatctcttttgttactgttttcacatcgctctagtacatcaactttagaaacaaaagacatcattctatttatagcattctgtttttaatagtggttatttccacttacaaaatatagtagttcttggttgggtgcagtggctcacacctgtagtcccagcactttgggattctgaggccggcagatcaccttaggtcaggagttcgagaccagcgtgggcaacatggcgaaatcccatctctactaaaatacaaaaattagccaggtgtagtggcgcgtgcctgtaatcccagctactcaggaggctgaggcaggagaactgcttgaacctgggagacagaggttgcagtgagtcgagatcatgccactgcactccagcctgggacacagagaaagactctcaaaaaaaaaaaaaaaaaaaaaaaagatagtaaatgttccaagaatagacttcacttgctaaaataccaaatacaaggcagtatttacaatagaaaatatgaatcattaagagatccaggcagtaaaaaactagaacaacatgaatgtctatcaacaacagagcaaataaattgtggtacattcgccatgaaatatagagcaaagaaccacaggttatatacatataaataaatctctcaaacataatgttaagcaaaagaagatagaaggccggatgcagtggctcacgcctgtaatcccaacactttgggaggctgaggcgggcggatcacctgaggtcaggagttcaaaaccagcctgaccaacatggtgaaactccgtctctactaaaaaatacaaaaattaggccgggcgcagtggctcacacccgtaatcccagcactttgggaggctaaggtaggcagatcatctgaggtcaggagttcaagaccagcctggccaacacagtgaaactccatctctactaaaaatgcaaaaattagctgggcgtggtagcgtatgcctgcagtcccagctactagggaggttaaggcatgaaaatcacttgaacccaggaggtggaggttgcagtgagcagagatcactccgcactccagcctgggcaatagagtgagatcgtctcaacaaacaaacaaacaaacaaaaatccaaaacttagccaggcttggtgatgcatgtgcctgtaatcccagttacttgggaggatgaggcaggagaatcacttgaacctgggatgcagaggttgcagttagccaagactggccactgcactccagcctagacaatacagcaagactccatctcaaacaagcaaacaaacaaacaaacaaacaaacagaagacagaagaatgggcaggcacagtggctcatgcctataatcccaacactttagtaagccaaaacaggaggatcatttgaggtcaggaatttgagaccagcctgggcaacaaagtgagacaccatctctacaaaaaaataattaaccgggtgtgctggcacacatctgtggtcccagctacccaggaggctgagcaggaggatcacttgagcccaagagtttgaggctacaggaagccatgaccacaccactggactccagcctgggcaaccgagttagaccatgtctcgaagaaaaaaaaaaaaagaagaagaagaatatatactatacgattacaattatatcaagttcaaaacgaggcaaaatttatgctgttacaagtgaggtatctgaggtactagtaaagttctgtttcctgattgggtactggttacacagatgttttttgtttgtaaaaaatttactgagctgaatactcacgcacttctctaaagtttgtcaaaatactggccgggtgcagtggctcatgctgtaatcccagaactttgggaggcctaggcgggtggatcacctgaggtcaagagttcgagaccagcatggccagcatggtgaaacccgtctctactaaaaacacaaaaattagttgggtgtggtggcacacacctgtaatcccagctactcgggaggctgaggcaggagaatcgcttgaacccaggaggcagacgttgcagtgagctgaggtcgctccactgcactccagcctgggcgacagagcaagactccgtcttaaataaataaataaagttgccaaaataagccattatcagcagttacttctagtgggaatattattaataattttaaaaatgtcttgcttctgcttatctgtatttcctaaattttctacaaagaaagcatacacatagaggcaggcatctcatttatactcctatgacattatacacaaagtctgaggtaaaaccagtaaaatgaaggaaatagggtgttttatgtaagaactgtgttgcagattagattctccaggaagcagatgctagacagaattcagaatggaaaaagtttaatgggaagtaacttctggaagaagtgcagaagcagcaggattgggcaagaggagccatcagaccacaatgcagacctgacaaagcctgtccaacagagagctcgggagcaaagacggccactcaggggaatctagtactgggcagaaagggcaaggctctaaatcactgcttcgctcaaccactggcagaaggctccaaagctgaggcagaccctaaaggagctaacagcttcagccagcctccttacagatggacagtaagtccttttgaagggataattttattattttttaatacatttatttctcttgctccacacactctacccagaccatttactatgccaccccactttacaaatttccagcattccctctagcactgatgaaaggaagaataagaagggtcttcccaaaattgggaaaagctggatttggcggggggtggggaaggaaacgaagagtaatctcgaaatatactttggggctttgagaaagatctgaaatgttccaaaaagtgacagaccggggagagcagagaacagaaacctcctacctcatctctaccactgcagtaattcatgcactaattatgtgtaacatcttttaaaactggaagaatcacattaaggaaaatgaaaacatgaactcataaaattgcttcccagataatttatctaccaaactggctgaaagcttatgatactacaaatgtttcctagcaaagtggctattagaatcttagtgataatcagcaaattggtggctacttggaaggactggagtggcttaagtccacctggtggtatgggggaaaggcactgacagtgagaaaggagcaattcccttcattccccaaaagcagagaagagtattataatgggtttcctgaaaactgtattagaaaaaggatcctaggccaggtgtggtggctcacgcctgtaatcccagcactttgggaagcttaggcaggcggatcacgagctcgggagttcgagaccagcctggccaatatggtgaaactccgtctctactaaaaatacaaaaattagccgggcatggtgccgtgcacctgtagtcccagctactcgggaggctaaggcaggagaatcacttgaacctgggaggcagaggttgcagtgagccgagattgcgccactgccctctagcctgggcaacagagtgagactccatcttaaaaaaaaaaagaaaaagaaaaagaaaaaggatcctagatagttatgcctctttccatgctcacgtgggtaaggtgtttttcaacatgactgactcgctagagggaggcctttcaaacaacagagacctccatttccagcccaaattcctatcctaaaacgtacagtcgccgagcatggtggctcacgcgtgtaatcccagcactctggaaggccaaggcaggcagatcacctgaggtcaggagttcaagaccagcctggctaacatggtgaaaccccgtctctactaaaaatacaaaaaactagctgggcgtggtggcacatgcctgtaatcccagctactcgggaggctgaggcaggagaatcacttgaactggagaggtggaagttgcagtaagccgagatcatgccaccgcactctagcctgggcaacaagagcaaactccatgtcaaaaaaaaaaaaaaaaaaatcaaaccatgccttttattactggaaaaaatatcacttcccatagtccctcttacttgttcccttatatattatcatttcctactggctaacttcactgatttattaactttcatatatattttttgttttattatttttttgagatagggtctcactctgtcacccaggctggagtgaagtggcacgatctgagctcactgcaacctctgcctcccaggttcaagtgattctcccacctcagcctcccaagtagctggcgcacatcactatgcccagctaattttttttttttttgagatgggagtctcgctctgtgccccagactggagtgcagtggcatgatcaaatttttgtatttttggtagaaacagggtttcaccatgttagccaggctggtctcaaactcccgacctcaagtaatccaccgtgcccagcctaactttcttatatttttaacctccactcagctctaaattcaccaaggaaaagagcccaaagaaatggattccttgactttggctgcatggttgacatttaaattaaatagttgctcccttgcacaacattttgacagactataagcctaaggtctgttgcagaacaaaatgaatcaatggaggctgcaaaagtttatttacattactatttttcccaatcagaataaatttgattcaataaaacaactcattctctttccaaattgtcttaaaatacaatagcaagccaacataaagagactcatactgctgtaatagccaatgtcaagcaatttccaccattcaactgttacaccctccacaaaaacatcaaaccccatacctttgagggcatgtttgctaacttggccctagccacagatgccaaggagaacacacatgggtgagctcagatgcaattcctctgtaattacatgcccaacaccaatttgcatagcccttctttttcacttccatgattaggtaataaaatcatcactcatattcccccaaggatatagaggcattttgaaactctgagtttttcttgttttcatgccaaaagaagccctacaaacttttcacacgtaagcatactaactcaatgaatgtaattttcatgaaactgtttaaaagaagtccttctcacccttcacatttgtgttacaccttctcagcttccccaacgtgactgaatgaatgtactggaatctgaactccctggaggcaggaccattggcctaggcatctttgtcttcttagtactaggcattcaaatgagtgtaaggtttattgacatgtctactcagaacacctttgtgctgagctcgcaagggttttttttttttttttaaagatagggttctgctctgtcgcccaggctagagtgcagtggcacaattatagttcactgcagccttgaactcctaggctcaagtgatcctcctgtcccaatgttccaaagtgctgggaatacaggtataagtcactgtgcccagtagttattttataatagaaattacatcattaggccaggcgtggtggctcacgcctgtaatcccagcaatttgggagtccgaggtgggtggatcacctgaggacgggagctcaagaccagcctagccaacatggcgaaaccctgtctctactaaaaacaccaaaaattagtcaggcgtggtggcaggcgcctgtaatcccagctacctgggacatgtaaaaaaaattacatcattagtatatccagaaaatggtagatcctacctttatatgttactagatgttgtcaaaatattttattggtcagaattaatacaaatctctggtttatggaattttgtaccttttaaggtatatatactggcctgagagtctgctgccagagaggaaactatttatttggcccagtagtatctttttcttccgaaaaactactatactaggccaggcgtgatggctcacacctgtaatcccagcactttgggaggctgaggtgggtggatcatgaggtcaggagttcaagaccagcctgaccaacatggggaaaccccgtctctactaaaaatacaaaaattagctgggcgtgcaggcgcatgcctgtaatcccagctactcaggaggctgaggcaggagaattgcttgaacctgggaggcggaggttgcagtgagctgagatcgcaccactgtactccagcctgggcaacagagcgagactctgtctcaaaatacaaaaaaaattttaaaaactaaaaaaaaaactatgctacatataactaaacacaaatcagtttctaaagtctgaatgccttacccttctgaggtataaattaaggttaagattttgagactggaagatgtggccactgtttctagctttaatgctgtgaaacctagcataagtcacacagagtaagaaacaaaaacctccctaagtaatgaaagttccccacttacttcaggaagattttgtaaagatagtagatatcaagaaactactctgaattcattggagaaaatccgtaacctagaaagaatcaactcaaaagaatttcaacatgggaatgaaactgctatgcatttaaaagccattgccagatttgagggcaatatttgattagttttttgcctttggtttctattcaactagacatctgacaatcctcttgtggtaaacacatctttattaaagttggaatacacttcatttacctaaaaggaagctgaacatttaaaatgcaatcaaacgtatttgtcacaaattcaaaaggttaaaaaatgtaattggccaggcacagtggctcacgcctgtaatcccagcactttgggaggccaaggcggaggaatcacaaggtcaggagtttgagaccagcctggccaacatggtgaaaccccatctctactaaaaatacaaaaaattagctgggcgtggtggtgggcacctgtaatcccagctactcgggaggctgaggccagagaatcgcttgaacctgggaggcagaggttgcagtaagccaagatcgtgccactgtactccagcccaggtgacagtgcgagactccgtctcaaaaacaaacaaacaaacaaaaaaagtaattaagggaacttcttaccgatagataataaaataaaggactgagacctaactaaagaataagggacagggccgggcgcagtggctcacgcctgtaatcccagcactttgggaggctgaggtgcgcggatcttttgaggtcaggagttcgagaccagcctggccaatatggtgagacccctactaaaaacaaaaattagccaggcgtggtggtgtgcacctgtaatcccagctacttaggaggctgaggcaggagaatcccttgaacccaggaggcggagattgcagtgagccgagatcgtaccactgcactccaaggtgggtgaggtgacaaagcaagactctgtctcaaaaaaaaaaaaaaaaaaaaaaaagaataagggacaagaaggaggagcagagaaaaataaaaagaagaagggactggactgaatggaggaacccacagtcatcccacagcatgagggcttctgaggctttagggacaaagcagcaaccctgaacagatgtcattatgaactcataaagtgaaccacttcagcagcactaatgtaggctaagtactaaatgctactcttgaaaatatactgttgaatgagagatttaaagaagatcataaagtgattcaatctaagacaataagccttcttatgaatataccacggttatcattttatcaactcaaatgaaaaagttatagaaagtagaaaaaggataaaataaaaaattctaccttactccgtgcattcaacaaatatcaatgaaacatttgctatatgtaaaaataccgtgcttattgcaagcttgactgctatcaaatattaaaaacacaaaaagaaaaaatatattatgcttagatcccacacagggtacaaaaagaagatatgtcactatttgctgtcaaacagatggacccactaagggccaaggacacataaattaataataccaacacagaacattatataataaatgacctatgagacaaaacaagaagccttaacagttcaagaaagaaagagatggcttctaactagtataaggaaggttcacagacaagcatttcagctgagctctaaagactaggtagaagccaagtgtggtgactcatgcctgtaatccaagcactttgggaagccaaagcaggcagaaaacttgagtccaggaatttgagaccagcctgggcaacatgacaaaacccttctctacaaaaaatacaaaaattagttggccatggtggcgcacacctgtagtcccagctacagggggtctgaggtgcgagcatcgcttgagcccaggagttagatgctgcagtgagccaagatcgcgcaactacactctagcctgggtgacacagcaagactccgtttcaaaaaatcaaaaaacaacaacaaaaataaagaagaggtagaatttcagagaataaaattggggaaggtgaagggattaaacattgtcaaattattgtaacttaaactgatatcctttgccacttacagaattacctttagagctgggtgcagtggctcacaccagtaaacccaacactttgagaggccaaaacaggcagattgcttgagcccaggagttcgtgaccagccaaagcaacaaagtgagaccctgtctctataaaaaatacacaagttagccaggcatggtagtgcaaacctgttgtcccagctacttgggaggctgaggtgggaggatctcttgagcccgagaggtggaggctgcagtgagccaatatcatgccactgcactccagcttgggcaacagagcaagactctgtcccaaaacaacaacaacaaaacagaattacctttaagacaaaacaaaactaaactaaaaaacacattttttacccaattgtttttaagtacacagtttaatattttaaattctacattaacgaagcatataatctagagactccttattattgacagtctatgttttgaccaaaaaaaaagcctagaaatagaataatttggcataaccattgttgctattagcaaactgtgagctattatgacaaattcaggaagctattttataaagcataccaaatttcataacagataccagctgcagtttttaaaaatggtgaactcattagtgtgctacccaattaagattcccttaataaaacagaaaaaatttaaaaatggaaaaataaagtattccacaaactacccatcaatatactttcttttttttgttgttttgtttttgagagagtctggctttgtcacctaggctggagtgcagtgaactcactcgagcgattctcctacctcagcctccagagtagctgggattataggcatgcgtcaccacgcccaactaatttttgtatttttagtaaagacagggtttcaccatgctggccagggtggtctcaaactcctgacctcaggtgatctgcccacctcggtctcctagagtgctgggattacaggcgtgagccaccacacctggccgaaaatttcatatggagaaccatacgttttaaattcagcaaaatgctttatttggtagaaaggtaaaatggaacttcagtgcccaaatttgtgtgtgtgtgtgtgtgtgtgtgtgtgtgtgtgtctgtgtgtgtctgtgtgtgttttgagatggaatttcgctcttgttgcccaggctggagtgcaatggcacgatctcggctcactgcaacctccacctcctgagttcaagcgattctcctgcctcagcctcccaagtagctgggattacaggcatgcaccagcatgcccggctaattttgtattttttcgcaaagacggggtttctccatgttggtcaggctggtctcgaactcccgacctcaggtgatccatctgcctgggcctcccaaagtgctgggattacaggcatgagccaccgtgcccagcctctttattgttaatacaactactcgagttttaaaatttcttcttgaggccaggtgcagtagttcatgcctgtaatcccagcactttgggaggccaaggcaagtggatcacttgagttcaggagttcaagaccagcctgggcaacatggtcaaactccatctctacaaaaaatacaaaaattagtggggtgtggtggtgcacacttgtagtctcagctactcaggaggccgaagtgggaggatcacttgagcccaggaggtagaggttgcagtgagccaagatcacaccactgtattgcaacctgggcaacagaaccaaaccctgtctcaaaaaaaaaaaaaaaaagaaaaaaattattcttgagttaattctgataggtgatgttttttctaggatttataagtcatctaaaacacgtaagccagaatcaactacacctttcattactcacataatttaaacaaacaactaataaaacatggagatgagctacataaatgtcatctaagtaatggctaaaggcccttaaacaagataggtctgctctgaaaacattcagtttactatgaaccatttaatcttcctaatcccaaaaggtgtcaaccaggaagcctgctcacttacacagcaccatctctctctcaccatctctctctatgacccacttctaaatgtcattttaacttccttttttccccattagagtgtacactacttgagagcagagactaagccatattatctttgtacatctggcacattagtagacaccttaacaatatcggtacttttttgatgaagatcataaagtaccttactgacgagggatgttaatgactcacttacggttgcaaagtatactcttgaggtgttcagtgttgaaagacttcactgaaccgtactttcacatggccttgcttatgaccaaaagcacaaagccatctgtaagacagttcatcttagttgggagtagagcataaaatgtatttttcttcactgacgaattaactgaaataaaaacaaatcttaagcaaaggcataattacacttttatgtaaatgtgcaatactgtcagaagcctagctgaaaaaccaaaaagtaaaacaaaacaaaaatgctaacttttaatcgtggtaagtcccagaagaaaaacattaaaaggagttcaaaattagaaagataaatagattcagagttaaagatagagcctaaactattttgcccaaaccattcaattctttaaagcattttaaaatccaagtaacacagaaaagtgaccatcctaagagtagagcttgatgaattactgcaaagtaaacacaatctcatttattttaagatgggaaagtttttgttttgttttttaagacggagtctcgctctgttgcccaggctggagtgcaatggtgcaatctctgctcactgcaacctctgcctccaggttcaagcgattctctcacctctgcctcccaagtagctgggactacaggcacacaccaccacacccagctaattttcgtattttagtagagactgggtttcaccatgttggccaggctggtctcaaactcctgacctcaagtgatccgcccaccttggtctcccaaagtgctgggattacgtgtgtgacccactttgcccagccaggacagtctgaaacaatcaaaatgatagacatatccaagtcacgcagcttatactgacaagtgccactgtgagaaattccaaggttttctataaaactggtaagactcaaagctcacaacccacatttgtcaaaacccacagcatcaaagagtgaaatttaatacatgtaaatttttaaaaaaaaccacttactcaggaggctgggggatcctagattatgataaaacaatccaactatattacaaatatatgagaccaccttgggtggaggaaaaggtgtaacctaagtaactttggaaataaggggcatctataaaactaaaggcaaaagaaacttcatataagcactagtctctacttgacaaagttgtttctcacaaaagcagaggctaacaatactaatctagctatacatgtatattggcattgaacgattaagtaaatagttggcagatggctagaccaaattttcttattggagtgggaatttacaaatagtcaaggaaggaagatagaatgatcctgtgataatggattagagtgggagacaggatgaactcatgtttaaatagatacagatggttacatataaatatttacaattggtgcataatatacacacacacacatatatacatgtgttagtatacactcatctaccaccttgttctgttaactgcaagggcctacaagtaataagcatacctagcacccagaagttctttctaataccgttctccaataaaagaaaccagggctccttggtgaaacggcagaatctaggaggacaggaaatatataagatgagcctggagaatccagtactgccacaaagtaaggaagtgccctaaaaacaaaacaaaagaaaattgatgggattggccgggtgcggtggctcacgcctgtaatcccagcactttgggaggctgaggcgggtgaatcacaaggtcaggggttcgagacaagcctgaccaacatggtgaaaccccatctctactaaaaatacaaaaattagctggccatggtggcgggtgcctgtaatcccagctactcaggaggctgaggcacgagaattgcttgaacccaggaggcggaggttgcagtgagctgagattgtgccactgcactccagcctgggcaacagagtgagactctgtctcaaaaaaaaaaaaaaaaaaaagaaaattgatgggattgtgtaaaaggggcaaaggaggcagatgaaagagctcctgatggtcaaaactgaaacaactgggccataaaataaattggtattggatcaaaaccccaagtacaggccaggtgctgtggttcatgcctgtaatcctagcactttgggagactgaggcgggtggagtgcctgaactcaggagttcgagatcagcctgggcaacagggtgaaaccccgtttctactaaaatacaaaaaattagccaggcgtggcggtgtgcgcctgtagtcccagctacttgggaggctgaggcaagagaactgctagaaccaaagaggcagaggttgcagtgagccaagatcgcaccactgcactccagcctgggagacagagagagactccatctataaatcaatcaatcaatcaatcccaaagtacaaaatgaatatccacaaattcatattgatataactgattaagaaaaaaaaaaaggctgggtgcggtggcttatgcctgtaaacccagcattttgggagaccgaggcaggcagatcacgaggtcaggagtttgagaccagcctggccaacatagtgaaaccccatctctactaaaaatacaaaaaattagctgggcatggtggtgcgcacctgtaagcccagctactcgggaggctgaggcaggagaattacttgaaccaaggaggcagaggttggagtgagccaagatcttgccattgcactccagcctgggaaacagagcaagataccatctcagggcgggggaaacaaaaaggggggaatctcccctgcagatttccaaataattcgtgtatgtacgttttcctctcacagtagtagagcataatttcccctaccttcctaacttgtctccacctaggtgaagttattatattattatcacacaatgtagctagacactaagctagttttacaatggacagaaagtaatttcattcctgcataccttgggcaaataaaactttctgtgtatctatgtcagaaaattcataatggggaaatgaagattaaaaaatttaaagtaggcagggtgcaggggctcatgcctgtaatcccagcactttgagacgccaagatgagaggatcacttgagcccaggagttcaagaccagctggggcaacacagactaggccctgtttccacaaaaaaaatttaaaaattagctgggtgtggtggcagctacttgggggctggggtggaaggatggcttgagcccaagaggtggaggctgcagggagctatggtcttaccactgcactccagcctgtgtgacagagtgagatcctgtcccccacaaaaattaatttatttggccaggcacagtggttcatacctgtaatcccagcactttgggaggttgaggcaggcagatcacaaggtcaacagattgagaccatcctggccaacatggtgaaaccctgtctctactaaaaatacaaaaattggccaggtgcggtggctcacgcctgtaatctcagcactttgggagaccgaggaggtgaatcacctgaggtcaggagtttgagaccagcccggccaacactgtgaaaccccgtctctattaaagatacaaaaaattagctgggcatggtggtgggcacctgtaatcccagctactcaggaggctgaggcaggagaatcactttaactcaagaggcggaggttgcagtgagccgagatcctgccattgcactccagcctgagcaacaagagcaagactctgtctcaaaaataaaataaaataaaaatacaaaaattagctgggcatggtggcgcgtgcctgtagtcccaactactggggaggctgaggcaggagaatcgcttgaaccaggaggcggaggttgcagtgagccaagacagcgccactgtactctggcctagtgacggagtgaaactccatctcaaaaataataataggctgggcatggtggctcacgcctgtaatcccagcactttgggaggccgaggtgggcggatcacgaggtcaggagttcaagaccatcctggctaacacggtgaaaccccgtctctactaaaaatacaaaaaattagccgggcatggtggcgggcgcctgtagtcccagctactcaggaggctgaggcaggagaatggcgtgaacccgggggaggcagagcttgcagtgagccgagatcgtgccactgcactccagcctgggcgacagagcgagactctgtctcaaaaagaaaataataataataataataataataataatttaattaaaaagtaaaaaccggcttggtgcggtggctcatgcctgtaatcccagcaatttgggaggccaaggtgggtggatcacctgagctcaggggttcgagaccagcctggccaacatggtgaaaccctgtctctgctaaaaatacaaaaattagcccagcctggtggtgggcacctataatcccagctattcagaggctgaggcaggattttcacttgaactagggaggcggaggtttcagtgagccgagatcgcactactgggcaacagagcaagactcagtctcaaaataaataaataaataaataaatgcagccaggcgcggtggctcatgcctgtaatcccagcactttgggaggctgaggcgcgcagatcacctgaggtcaggagttcgagaccagcctgaccaacatggagaaaccctgtctctactaaaaatacaaaattagccaggcatggtgatacacgcctgtaatcccagcactcgggaagctgaggcaggagaatcgcttgaacctgtgaggtgaaggttgtgttgagccgagatcgtgccattgcactccagtctgggcaacaagagcaaaactccatctccaaaaaaaaaaagaaaaagaaaaagtatatgatatcagttgctggttatatctcattagctttaatagttagtcacttctgatacagcatatgttttgttcattctgggataacagatttaggacagggaaaaacaagtgaaataaaaatgtaatcccctctttgccacctttgataaatttaatcacatacactgagagctttgcttgcacttaaaaatgacagtaaatttataggttaaaattttaaaattgttccaacaatgggaggcacattgttattattaccattgctatagttgaatgaaggaagattaaatatatctattattctccaaaaaaaatgcttatggaattgattaaaagatttaataaatgacattgctatattgtgatttagtaagcaaataaagttatcctcctggaggttggaaaataaatcttacttggtttaactactcctattaacaatgtttcaactaatgaatttcttttccttttttttttttttgagacggagttgttctgtcactcagggctggagtgcagtggcacaacctcagctcactgcaacccccgtctccagagttcaagtgattctcctgcctcaagctgctgaacagctgggattacagacatgtgccaccatgcccagctaatttttgtatttttagtagagatacagtttcaccatgttggtcaggctggtcttgaactcccgacctcaagtcatatgcctgcctcggcctcccaaagtgctgggattacaagtgtgagccactgcgcctggcctcgactaatgaatatttttgataaaatgaataaaattatcaggcaatagtgaccaaagcatgtcatgaatttaacaatgagaagagtagtggctttttccaacagatttcaattcagtcatctgaagtacttgtttgtgaaataccttaaactcctttctcatttctagtctctgctcttgctggccatcccctcttgcagaaataccgtactcctacttgccagtaggacaaattcctactctgccacgtaagagttacctcttcttgaggttctatcccctccagccaattaagtattcctctgaccttctattcattttgtacagtatcttcattatctcaaagttatataaatatttgttgagagaggtggcctacaagacgtaagccaacattagataaatactagagatagtttctacttttcaccacttcataagttacaattttgcttattaaccacttgcctaattaaaacccacattaagagccaggagtggtggcttatgcctataatcacagcaactcaggagactgccaccagaggatcgcttgaggccaggagttcgagaccagcctgggcaaatagtgagaccccccccccccatttccaagaagaaaaaaaaaatgctaggtatggtggtgtgcacctgtagtcccagctatgtgggaggctgaggtgggaagatcacctgatgattgcaccactgcactccagcctgtgacagtgcaagacgatctcttaaaaaattaattaaaatatgaaaaaataaaatccacattttacttctcattgctatggcttccaataaagtcaagacaaggcaagagcactaaagcaatcaagatgcaaaaatgcacagccacgagtttgctttaaggaaaatatgccttaagatgtggtgtccagaaatgtgaaaattgccaataccaattgtctttttatgtgtgttgaatcatactgtatttcagatgggtagtgttatggctgaaaactgttaatactagttcaattttaacagtcagcatttaaagggatggaatccagaaaactaatttccatctctgaccttctataaatttgctatgatctcaggaaaattgattttgcatactgtatcaactgtacggtaaaaataataatccatcagaaacttcaaaaggctatattctgtaccatttctatgaaaataagtgatgactgtgcagaatacaaatatattcaaagatagcttataatatgaaattcagctaccagacagaaatatggggaggacagaagtgttcacttcatttaagactgattctaggccgggcccggtggctcacgcctgtaatcccagcactttgggaggccaaggcgggcagatcatgaggtcaggagatcgagaccatcctggttaacacggtgaaaccccgtctctactaaaaatacaaaaaattagccaggtgtggtggcgggtgcctgtagtcccagctactcgggaggctgaggcaggagaatggcgtgaacccgggaggcggagcttgcagtgagcggagatcgagcctgggcgacagagtgagactccgcctcaaaaaaaaaaaaaaaaaaaaaacagactgattctacagataagactaatgacctgagaacacctccctggcacttggagcaaaaggccagtgatatggtctatgttaaacagtccacttttcaataatgtttaaaataacccacaactaacaacataatttcactgcttcatgtttactattctgtatcagtttacaaactaaaattaaactgacacacacttaacagaattcccgacaacacaataacattaccatacaaaagataataccaaggttgttatgagttatctagttctctgttacttccttaatgctgtaaactacaaatcagaaccccaaataggagaaatgctaaatagaaagtacataaagatgactcatacaggcaaacaggtatgcaaaaacattcaaagttctctcattcttaaacactgaaattccttaaagcaaatacaaattaaatggagttctagaagggtaaacagtgatccttagtatcaggaagaaaaaactattttaataatggccacgcgcagtggttcacacccgtaatcccagcactgtgggaagccaaggtgggcgaatagcttgagcccaagagttcaacaccagccctggcaacacagcaaaacctcgtctgtacaaaaaaaaaaaaaaaaaaaaaaaaaaaattagccaggcttggtggctctgtctcaaaaaaaagagaaaagaaaataaataaaattaccaacatggtggcttgtgtctgtatcccagcgactcaggagtctgaggtgggaggactgtttgaggccaggagtccagctggggcaacatggtgattctcctgcctcaacttcccaagaagctgggactccaggtgcacaccatcaagaccagctaatttttttattttgtagagccaggatttcgccacatcgcccaggctggtctcaaactcctgggttcaagtgatcctcctgtattggcatccaaaagtgctggaattacaggtgtgagacaccatgcccccggctcatatcacttcctaactaatctgccacaattagagagaattagctggtttcccacttccttccttcttccttcttcaatctattctttatttcgctgtagtattaaacttcatgatgcaaatctggatcaaaaacttttgactgggccaggcacagtggctcatacctgtaatcctaccactttgggaggccgaggcgggtggatcaccagaggtcaggagttcgagaccagcctggccagcatggtgaaacaccatctctactaaaaatacaaaacattagctgggcgtggtcgtgggcacctgtaatcccagctactaaggaggctgaggcaggagaatcgcttgaacctgagaggcagaggttgcagtgagctgagatcacgccattgcattccagcctgggtgacagtgcgagactccatcgcgccaaaaaaaaaaaaaaaaccttttgactgttttaaggcctattctttaaaattcaaggtttttaaattttgttttgtttttgagatggagtttcgctcttgttgcccaggctggagtacaatggcgcaatctcggctcattgcaacctcactgaacacctcctgggttcaagcgattctcctgcctcagcctcctaagttgctgggattacaggcgcctgccaccatgcccggctaatttttctgtttttagtagagatggggtttcaccatgttgcccaggctgatcttgaactcctgacctcaggtgacctgcctacctcagcctcccgaagtgttgggattacaggcatgagccaccgcgtctggcctaatcttactttttgtgtgcctctcctcactctggtctattcctctctccttcagccaaatgatcgtaatattctctcttcccacctctatgatcctttattcttgctgcccttttttgtttgtttttgttttttttttgagatgtagtctagctctgtcacccaggctggggagcagtggcgtgatcttggctcattgcaacctccacctcctgggttaaagcagctctttgcctcagcctcctgagtagctgggattacaggcagacaccatcacgcctggctaagttttgtatttttaggggagaggggtttcaccatgttggccaggctggtcttgaactcctgacctcaagcaatccacctgcctcggcctcccaaagtgctgggattacaggcatgagccactgtccctagctgggccaaggtttaatttggacatattcatagaagaaggatgtctgggctgggtgcggtggctcacgcctataatcccaacactttgggaggctaaggcaggtgaatcacctaaggtcaggagttcaagaccagcctggcaaacatggtgaaaccccgtctctactaaaaaatacaaaaaatagctgggtgtggtggcaaacgcccgtaattctagctacttgggaggctgaggcaggagaatcacttgaacccgggaggtggaggttgtggtaagcagagatcatgccattgcactctagcctgggcaataagagcgaaactctgtctcaaaaataataatataaacatttctgcaattggactgtctttccaaacacaagtgcacatattttatctaaaatagtttcagctaagagtgcacagcaaaaacaactgtccaaagataaaagaacaaccaaatcattaggtactcagaggaaatctcattcaatatctcctaaggttccaatgcttctcaaattttaatgtgaatctagtttatagattcagattcagtaagcctcgggtggaacttgacactgtattctcaccttgatgatgccagcactgccagtttggggaccttgagtatcaaggtcttcagtaaccattaaaatgtagctggtatcaacactagatgagaaaatggaatcaacaggtattgagaacatgtgccaggtgccttatctcatttaatctttacgtcaactctgtgaggaacatattatcaattctaagatgaggataagatgaggaaaattgaggctgagataaattaacttgcccatgattacacagaaccagatttgaacccaatcataggactccatttattctttttaagagatactataaattgtcattgaaattaacttcaaaccatcctcaaaagaataataggccaggccaggcacagtggctcacgcctgtaatcctagcactttgggaggccaaggtgggcggatcacctgaggtcaggagttcaagaccagcctgcccaacatggtgaaacccccgcctctacaaaaaatacaaaaattagctgggcacggcgacaggcacctgtaatttcagctactcgggaggctgaggcagaagaattgcttgaacccaggaggcagaggttgcagtgagtggagatcgcgccactgtactccagcctgggagaaagagcgagactccgtctcaaaaaaaaaaaaaaaaaaaaaaaaaaaaaaaaagaataataggccaaacacagtggctcacgcctacactttgggaggccaaggagggaggattggccgggcgcggtggctcacacctgtaatcccagcactttgggaggccgaggcaggtggatcatgaggtcaggagatcaagaccatcctggctaacacagtgaaaccccgtctccactaaaaatacaaaaaattagccaggtgtggtggcaggcgcctgtagtcccagctactcgggaggctgaggcaggagaatggtgtgaacctgggaggcagagcttgcagtgagctgagatcatgctccactgcactccagcctggacaacagagcgagactccatctcaaaaaaaaagagggaggatcgcttgagcactgaagttgaggctgcagtgagcctctgcactgtagcctgaggaacagagtatggccctatctccaaaaaaaaaaaaaaaaaaaaaagaataacaatgttgcatgacatcttgtcttggatacagactttcactttcctctattacctgtttcttcaaaacgtcctaccttttattgttatccccctgctttgatgctgggcattgtcatccacacttgaaccaaaatagtagacacctacctaactgttctgactctagccttttgcctcatcaatctagagattattctgcagtctccaggaatttactaaatgtgagcagaccagtagcatggtaaaaacagtgtttcaagaggaattcaaagtactttacaatcccacaatgctcctatcaaatctctcgggtggcatataaacctagcttccccactgataaacaaaaatattctgcaaagaacataatacattttaacaagatgctgtgatggaatggaacattttatttccatttgtcttttttttttttttttttttttttgagacggtgtttcgcccttttccccaggctggagtgcagtggcacaatcgcggctcactgcaacctccgcctcccaaattcaagcaattctcctgcctcagcctcctgagtagctgggattacaggtgcacatcatcacccccggctaatttctgtatttttagtagagatggggtttcaccatgttggccaggtggtctcaaattcccaacctcaagcgatccacccatctcagcctaccaaagtgctgggattacaggcgtaagccaccctgcccagcggtcatttatcttttttctagtggtggtcagggcaaaggaatgccttcctgcttctgcctcctactcacttctctagagcagaggagaggacctccttccatcacaagtcatttcctactccattccacattaatcatttccagaagtccatctataccattacttatcgacacaatgtcacactatttcatattgttatagtttttttgtttttgtttttttgagatgaagtctcactgtgttgccaggctggaatgcagtggcatgttcttggctcactgcaacctccgccacctgggttcaagtgattctcctgcctcagcctcccgagtagctgggactacaggtgcgtgccaccacgcccagctaatttttgtattttcagtagagacagagtttcaccatgttggccaggatggtcttgatgtcttgacctcatgatcagcccgcctcagccatccaaagtgctgggattacaggcatgagccaccacacccagccatagttatgttcttatgtaaattttctcaataaccagattacacatttttggttaatacttgcacagctgaacagattatgaatttatgaaaggtagataatgtcttgattacatcttatccccaggaaacctaaaggacagtggtgtatatgcacatgaagtaaatctttgcttcacctgatcataaaaatcacctggccaagcacggtggctcacacctgtagtcccagctacttgtgagtctgaggtagaggatcacttagcctgggaaatccaggctgcagtgagccatgattgtaccactgcgctccagcctgggtgataaagcaagaccctgtctcaagaaaaaatttaaaaagtaaattaccatcctggctaacacagtgaaaccctgtctctactaaaaatacaaaaaattagccaggcgtggtggcaggcgcctatagtcccagctcttgggaggctgaggcagaagaatggcgtgaacccgggatgcggagcttgcaatgagccgtgatcgtgccactgcactccagtctgggcgacagagcaagactccagtctcaaaaaaaaaaaagtaaattaaaaaaattaaaaatcacctagcaggtagatttcctggagactgtttcagaaaaataggcatgaaagcagaaatcttaattctatcaacaagcaccacagatccaaatccagaaaacctttggtagtactttttttttttgagacggagtttcactcttgttgcctaggctagagtgaaatagtgccatctcggctcactgcagcctccgcctctcccaggttcatgcaattctcctgcctcagcctcccgagtagctggaattaaaggcgcccaccccgcccagctaattttttgtatttttagtagagacggggtttcaccatgttggccaggctggtctcaaactcctgacctcaagtgatccacccaccttggcctcccaaagtgctgggattacaggcgtgagccactgcgcccggccaaccctctactgagggttagggttttgccatgccaaggttaagttacttctaaaacttaaccttatgttctcatttataattttcttacaatgctttatacactttactgagcaataggcttaaaatacggttaataaaacttgcagaaaaatacaaaatagtataagcaggagtagatattatagaacaactgaacccttatttcacaaatgaggaaagtgaggtcagaaaacctaagtggctttaaggtcatacagccaatgagtagcaaaaatagaaactgtatcttttgtctttcagcccagcacttcttctattgtaccataccaaaatttatttataaaaaatcagcagtaaagcattatttactaatgtccatcaaaaacagaccagttgaacaaactctggtgcatcctcactgtgtaggtgtggaaatgaataaggactacctctgttccaatatggaatgatctccaaaatatactaggtgaaaagaccaagaggctgagcagcgtatatagtaggaaaaccttttgcataagagaaaaaaagaatatatgcagatatttgcttattattgcaaaatccaacatttaaaggataaaccaaaaccaaataaatattagaatggttcaagcaccaaccatgagacaacccttggcaattcctcctcaaagtcccagctataaaagtggtagtaggctggaagccgtggctcatgcctgtaatcccaacactttgggaggccgaggcgggcagatcatgaggtcaggagttcgagaccagcctgaccaacatggtaaaacaccgtctctactgaaaatgcaaaaattatttgggagtggtggtgcacgcctgtaatcccagctactcaggaggctgaggcaggagaatcgcttgaacctgggaggtggggaggcagaggttgcagtgagccaagattgcacccctgcactccagcctgggcaaccaagtgagactgcgtcttttaaaaaaaaaaaaaaaaaaaaaaaaagtggcagtaagtttgagtggtggtccctactatttgatattcttaaaagttctgggccgggtgcggtggctcatgcctgtaatcccagcgctttggtaggccaaggcgggcggatcacctgaggtcaggagttcgagaccaacctgaccaacatggagaaaaccccgtctctactaaaaatacaaaattagccaggcatagtggcgtctgcctgtaatcccagctactcaggaggctgaggaaggagaatcgcttgaacctgggaggcggaggtcgcgatgagccaagatcgcgtcattgtactcaagcctgggcaacaagagagaaattccgtctccaaaaaaaaaaaaaaaagttctgggccaggcgcagtggctcatgtctgtaatcccagcactttgggagtctgaggtgggtggatcacctgagcccaggggttcaggaccaccctggacaacatggcaaaaccctaactctacaggccaggtgcagtggctcacgcctgtaatcccagcactttgggaggccaagacgggcggatcacttgaagctgggagttcaagaccagcttgaccaacatggagaaaccccgtctctactaaaaatacaaaattagccgggtgtggtggcacatgcctgtaatcccagctactcaggaggctgaggcaggagaattgcttgaacctgggaggcggaggttgcggtgagccgagatcacgccattgcactccagcctgggcaagaagagcgaaactctgtctcaaaaaaaaaaaaaaaaaaaaaccctaactctacagaaacaatggacacggtggcacctgcttgtagtctctgctactagggaggctggggtaggagggtcacctgagcctggggaggtcaatgctggagtaaaccgtgatcgcccactgcactccagtctgggaggcagattgagatcctgtctcaaaaaaaaaaaaaaaaagttatagtaataccatctcctcccttttgttcccctgacccttaatagtttcaccctacagtaattaatttctaagttacctactgctatggtttagataaggtttgtcgccaccaaaactcatgtggaaatttgatccccaatgtggtggtgttaggaggtggggcctactgggtggtgtttaggtaatgggggcagatctctcatgagtgacttggtgctgttctcctggtagtgagtgagttctggctctccgaaactagattagttcctgggagagtaggttgttataaatcaggccatccccaacgtttcccctattcacatgtcaacttcccctttgacctttcctgccacactgtgatacagctggaaagccctgccagaagccagggccatggacttgaacttcctagcctgtagaaccatgagctaaataaacctcttttctttatataataaattacttaatctcaggtattctttacagaaacacaaaatggactaagacacctactctaccatcttttgcccttctggtgttataacacatatgtaaccaattccctatattaaatttcctctttgaaatatttagtatattttccagtttttggctggatcctgatggataaaaaattctaaggatttagaagaactgcaggctaggcgcagtggctcacgcctgcaatgccaacactttaggtcaaggcaggtggaggattgcttgaagacacgaattccagaccagcgtgggcaacatggcaaaactccatctctacaaaaaacacaaaaaaattagcctggcatggtggcatgtgactgtagtcccagctactcaggaggctgagatgggacagtaacttgagcctgggagggagaggttgtagtaagcagagattgcaccactgcactccagcccaggtgacagagccagaccctgtgtctaaaaaaataaaaatcaaaaaaattcccagcactttgggaggccgaggcaggtacatcacgaggtcaggagttcaagaccagcctcgccaagatggtgaaaccccatctctactaaaaatacaaaaaattagccaggcgtggtggtgggtgcctataatcccagctacttgggaggctgaggcaggagaatcgcttgaacccaggaggtggaggttgcagtgagcccagatcgtgccattgtacttcagcctgggtgacagagactacgtctcaaaaaaaaatattggccaggtgtagtggtgcccacctgtagttctagctactcgggaggctgaggcaggaggatcgcttgagccaggagattggggctgcattgagccataatcacaccacactttagcatggcaaaaaaaaaaaaaacaacaacaaaaaaagaaaactgcaaagggatcttttttttatttttttgaaacagagtttcactcatgttgccaaggctggagtgcaatggcgcaatcttggctcaccgcaacctccacctcccaggtttaagcgattctcctgcctcagcctcccaagtagctggaattacaggcatgtgccaccacacccagctaattttgtatttttagtagagatggggtttccccattgttggtcaggctggtctcgaactcctgacctcaagtgatccacccgtctcagcctcccaaagtgctgggattactttaagttagcttcaggtattttattagtagtaatatggaatatatataatttttttttttttttttgagacagagactctaccgcccaggctggagtacagtggcttgatctcagctcactgcaacctcggcctcccaggtacaagtgattctcctaccacagcttcccaagtagctgagattacaggcacataccaccacacccagctaacttttttttttttttttttttgtattttttagtagagacggggtttccccatgttggccaggctggtgtcaaactcccaacctcaggtgatctgcccacctcagcctcccaaagtgctgggattacaggcgtgagccacagcacccatccagttgttacatttttaaaccttcttatacatacataggataaagcaaataaatgttaatattattaaaaccaaatatttcagtatgagacaaatataaaatcaaaagaaaaaatcccataaatgtgttaaattcagttgtaaatatcaatataaagttctgatttctaataatattttctgggccgggcgtggtggctcacacctgttatcccaacactttgggaggccaaggtgagtggatcatctgaggtcaggagtttgagaccagcctggccaacctggtgaaaccccatctctactaaaaatacaaatattagctgggtgtggtggtgggcacctgtaatcctagctactccggaggctgaggcaggagaatcacttgaacctgggaggcggaggttatagtgacccaagattatgccattgtactccagcctgagagacagagtgagactccgtctcaaaaaaacgacaacaacaaaaaaacatatatatatattttctgagccaggcgcggcagctcacgcctgtaatcccagcactttgggagaccaaggcaggcggatcacgaggccaggagttcgagaccagcctggccaacatggtgataccccatctctactaaaaatacaaaaaattagctgggcgtggtggaggacacctgtaatcccagctatttgggaggctgaggcaggagaattgcttgaacccaggaggcggaggttgcagtgagctgagatcctgccactgaactccagcctgggtgatggagcgagactctgtcttaaaaataaaatagaataaaataaaataaaattttctagttgtgactactgaaaggacctagaaacaatgaagaccctgtagcaatgagcatccctagcacacagatcctggtttctactggcattccctgtaaaagacactgagtcgccaggcgcggtggctcacgcctgtaatcccagcactttgggaggccgaggcaggcggatcacaaggtcaggagatcgagaccatcctggctaacaaggtgaaaccctgtctctactaaaaatataaaaattagctgggcatggtggcgggcgcctgtagtcccagctactcgggaggctgaggcaggagaatggcatgaaccggggaggcagagcttgcagtgagccgagatcaagccactgcactcccgcctgggcgacagagcgagactccgtctcaaaaaaaaaaaaaaaaaagacaccaggtcttcttagaaaaacgactaatttcacttcaatgacaggtagatacaaggtgaatccgggatagcttgttgtgacaaaaaataaggaagcactccaagaccaaaggtgacatatcagaaggacacactaccaacttaaggaggcttatgctggccaaatttcagggtcagaacgactaatggtgagaacgaagtgtaaaataatgaataaattaaaatccatgtacaatatagtgatacagaaagtagcaaggaaacttatttgctaccactgaggtgaccacttcaccaattctttacgaagaaatttataatgaaaagcaaaaaagtaaacaccctaccttattagagatcaataaaggaaacatttgaaagtgcgtttacccccatactagtgaattccttaaaacaactgaaagtatcctaaatagaaaatattctaagggaacattaccagctaaaaccaaaacacgcttgcctttatagaaattaaatgaactacttcaaatctatttattactagaaaataagagagcgaggcgtagtggctcacacctgtaatcacagcactttgggagtccgaggcgggcggatcatgaggtcaggagatcgagaccatcctggctaacacagtgaaaccccgtctccaccaaaaatacaaaaaattagctgggcgtggtggtgggcgcatgtagtcccagctactgaggaggctgaggcaggagaatggtgtgaacccgggaagcagagcttgcagtgagccgagattgcgccactgcactccagcctgggcgacagagctagactccgtctcggggaaaaaaaaaaaaaaacaagagaaaataagttactaagctaaattactgtactgaacagtacatttttttttttttttttctgagacagagtctcactctgtcgcccaggctggagggcagtggagggacatcaactcactgcaacctctgcctcctgggttcaagtgattctcctggctcagcctcctaggtaactgggattacaggcacacactaatttttgtatttttagtagtagagatggggtttcaccatgttggccaagctggtcttgaactcctgacctcaagtgatccacccacctcagcctcccacagtgctgggattataggcatgagccaccgcacccggcctgtcagaatagtacaattttaaaagtgactattgccatatataataactatacatttatcagatttatatagtgtacatatataaatacacttatctgtgtgtgtgtgtgcgcatcaaagcatcacaagatacatccacctttgaagcaaaacactggaaaaaattaaaaactcagaaaaaaactttacaggccagcacagtagctcatgcctgtaatcctagcactttgggaggctgaggcaggtggatcacttgaagacaggagttcgagagtagcctggccaacatggtgaaaccccgtgtctactaaaaatacaaaattagccaggcatggtggtgtgcacctgtaataccagttactcaggaggctgaggcaggagaatcacttgaacccagaagcaaaggttgcagtgagccaagatggcgccactgccctccagcctaggcaacagagagagacttcctctcaaaacaaacaaacaaacaaacaaacaaacaactttacaaattaaaaagtagaaatttcaggcagggcactgtggctcacgcctgtaatcccagcactttgggaggccaaggccagcggatcacctgagatcaggagctccagaccagcttggccaacatgttgaaaccccatctttactaaaaatacaaaaattaggcaggcacagtggctcacgcctgtaatccccacactttgggaggccgaggcgggcagatcacgaggtctggaaatcgagacaatcctggctaacacagtgaaaccctgtctttactaaaaatacaaaaaattagccagctgtggtagtgggcgcctgtagtctcagctactcgggaggctgaggcaggagaatggcgtgaacctgggaggtggagcttgcagtgagccgagatcgcgccactgcactctatctagcctggcgacagacccgagactccgtctcaaaaaaaaaaaaaaaaagaaaaaaagaaaagaaagacttgcctataagtcataagctatattataagcttaatgctggacaatttttaaatgacttgtctgtaagtcatatccttgtacatgtagcaagctgtcacattatagaaaactgaacacatcaccttcacttttccatcagccgcaactttagatcactcattttcagttaagatacagatggtatatgttcaataatacagtgccacataaaaatttcactcaatccaaaaattcgaagtttttgcaatataggcaacaacacgctaaattaattgtacaacaactacagcactaaggtaaataacttgtactgggatacagaagttcaatatcaaagctactagcaacaccaatccacatagattctataaaagtttagtgtaattcgtcgggagcggtggctgaagcctgtaatcccagcactttgggaggcaaaggtgggcggatcacatggtcaggagttcgagaccagcctggccaatatggtgaaatcccacctctactaaaaaaaaactacaaaaattagccgggcgtggggcgggtgcctgtactcccagctactcgggaggctgaggcaggagaatcgctggaacccgggaggtagaggttacagtgagcagagattgcgccactgcactccagcctaggcgatagagcaagacttggtctcaaaaaaataaaaaagaaaaagaaagtttagtgtaattctcacttaagcggtcagcttcaatcaaaaaggaattaagatcttctcattttatttattgttgggaaaaaggagacagtactaataaccacctataatcaacattgtaaggaataacaattaaatatttactgtattaattgtcatcaaattaaaaacacagtgcctcttgtactagtttacaaaacaaaaacaaaaaagcatcatcactctaaagttgtcaccacttagtaatctgagatattttaattgcagctgcaatgtttgtgtttgttgcctgtgtatatgactcatatagaaaggttttcccaagactgctggatttttgagaatgcagaagccataactggggcatactgtgtgggaactgtcatgacagtgaatgaataaaaggggaaaagaacccatgacagaattttttttcaagtttttataaaaagcaagtcactcactaaaggcagactctgcagaataataggaaaggttggggaaaagccatccctgctccaagaagccttccttgactctcttggttggattcagtgcacttcttaacactacatagcacttaacgggtttccttgtctggctccccagccatactatatgcaacttcagaccaaaagctgtcttaaattagtacctacttcccaaaacacccgccatatggagggccctcagtaggtggttcataaataggaataatcaattttacatttaccttttattttacattttacaaagcactttcacgaacactatcttttctgatccacattaacaatcgtgggaagggctttatttaatcaaatggcttctggttttataaagagttaattcagggccgggcgcagtggctcaagcctgtaatcccagcactttgggaggccaaggcaggtggatcgcctgcggtcaggagttcaagaccagcctggccaacatagtgaaaccttgtctctactaaaaatacaaaaaattagctgggcatgatggcaggcacctgcaatcccagttactcaggaagctgaggcaggagaatcgcctgaaccggagaggtggaggttgcagtgagccgagatcattgcactccagcctgggaaacaagagcaaaactatgtctcaaaaaacaaacaaaaagagttaattcattgactaaaacaattctgaaatcacaaagataattacgtatttgttcatctttgagatagcttctccctgggacctcagtgttctcataaaactcagacgttttgttagcattttctttgcttgctctccataataggtaggactcaccctgctctgaatcttactcagggtttaaaccacataaagctgttattaaagacccctctagaaatcagacaagaagaagcatcctaagctattttttttctgatcctgttctttttgtaactaaggtaaggaattgcaaaggtcaaaatctggagagcaaatgatgtcatggatgtcatgaagttgcatcaatacctgatgatgatttagcataacagtgcaacatattatgccaagaagcataatgatgagccaccaggatgttttactgcattaatttcatgactctttattagcaaattgatatgcaaagtagctctccaattttctaccacagagaagctgctggttcagatttacatctttagcaaagacactaagaaaatcgacaaatttctatggaaaagtctttgatttaaaaatagaaaaggaggctgggcacggtggctcaagcctggggtggggcagggtatcgcttgagaccaggagtttgagatcagcctgggcaacatcggtgaaaccccgtctctactaaaattacaaaaaaaaaaaaaaaaaaaaaaaaattagcgggcgtggtggcgcacacctgtaatcccagctactcaggaagctgaggcaggagaatcgcttaaacccaggggatggagattgcagagagccgagactgtgctactgcactccagcctggatgacagagtgagaaactgcaaaaaaaaaaaaaaaaagaaagaaagaaagaaagaaagaaagaaagaaagaaaatggtcaaataataacctaaacagttgtcattttaacaatgaaaagctttttaagatacgcaacatgcctatggatcaatgtagattgaatcatctatttatactggcttgtcaaaagcaaacagttactgggtataaaatgacaacatacaatagaaaagacacccaatcagattacacacgtgaatacactcaaagttagcaatttaacacagcatcactaatggccataagatatacagacttaattctaaatattcaattctaaatgatggtacttcccccaaattttccttgcctctttaaatccatgatgtcatcattcttaagcagaagtaaagccaatttgttacaaaagatattttggtgtgtccaagcaaaagcaatcgcctcaacaattctgcatagcacaagttcagtgaagccatcattcctcaagaaagagaccacaaggcttcaaaccgacttccctacatgacagaaacacaatcgaagtctcccaattagcatttaaacagcaataaaagttgttctcaaaaaggaacaacatagtttcaacgtcggggccagcaactgccagcaagtaaaactggtaatgtgtcagaatcttcatctagatcgatcagaatcccaccacagaaaaatccagactctggcaattaagaaatgaggcttttattttcctaacagaaatcgggagatttaacagacaaagcaattggttattctgaatcttaacaaaccgaaggtttcaaacgaactcagcgctgaagttactctgcagcgaccatcaagatctcacaatcgttttctcttcgcttacaaattcgttcccaccctccaccgttccctttgcacacacaattctcgccaagagaagccttccacagtcacagcatggattgctgtctcaagcaaggagatccgcagttcccatttctctaagggaacactcaacaagctaggggataggaaaggccttttgtgttttatttaacgtaaaccaattccaaaattatccctttgcagctgcaggttcagagatgctagcccccagccgcagccccaattttgatgggcacccgacccccgactcctctctcgcaaaggagtgaaatgttcggaggagcgatgaaagattacctgacaccctaaagccatccttgcccgggccacacaccccttcactgcccgggtgaggggacgagaaccaccctgctgaggagagggggtgggttcgctcccaacccaagggctggctggaaaggagctgtcctcctcctcgcctcactcgaggacggcgatagcaagtcaccctgcccaaccaggaccgacccccgcgtgggatacggggcctgcgtcagaccccgggcgcccgctgccccttgccagtcccgggcataaagggcagaaggcgccggctcccctctgcggcccggggaggaggagaggcctcacctggcccagcccgctccacgctctcgggttcgctccgctggcgacggtaatgagggagccagggacagggccagagcagaggcgctctgcctcaggccgcgacagccgtgctcggggctcctcacagctggcgggaccccgagccgcccggagccgccatcttcctccactcaaacgccgccgccgccgcagctgctgc

SEQ ID NO: 1926 - DNA, 3714 bp, Homo sapiens
gagtcgtctttgtgagcccgccccggcggggaggagctgcccggctcaggccccgcccacccggaggatcttggggctggtctgagtccgctcctgagacgtgaccacccgccccgcatggggccccagtcccagctgcttgatccggctcagccccgaggtgtttgcagcagctctttatgaaagtccagccatctgttacctgcgttgcttcctggggagggatagtccacctggaggcattcggagacccagtgattgtgctccgcggagcctgggctgtgccccgcgttgactgcctcatagataccctacgaaccccaagtaagaaaaaacgacgaccctctctccgtgagtctcactggggtgctgacctagagtgaaccctgcttgcttagggctcctgacccagcgcttgtcctttctcagggtggatggggcgagacccctgctgggataaatgttttccctggggcaagggctgtgcacttcgcagctgctgggtcccctccctaggatccagggagacactcactactcctctccattctgtgttttagatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggagggtgagatgtcctggcttcccagaacagctgggggcatctttgcatccccaccacaccgtcctggcctggctccctgagaggggttcaggggcaatacctcctgcagtcctaaggaggaagggaatggttaagggcgggtcttcacggggtttggggcaggctctgggacagatatgggtttagagggtgcaaggggccctggagtggcccagggggaaagcaggggatctgagctgcccctccctcagacaggcctcatggtcgcatgctaccacggcttccagagtgttgtggccctgctcagccactgtcctttccttgatgtgaaccagcaggacaaaggaggggacacggccctcatgttggctgcccaagcaggtgtgaggctgctgcaccccacttccgacagcccccttttgatgcagacagggcctcagccccacccttgttgcacggtgttctacaccagactctgtcatgctgggtggagggcggtttgggagcttcatcaccccctttcctggggaccaagcttacccttgctgccctgcaggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgtgcggggcctggaccggggtgtgtggcctccagtccctcctccaagccttcccaccagacactaagtcagctgtgattatttgcagaaaggagagaggtggagatgggggatcaatctagttcaccttcctggaggggggggcacatgatttgggcttcgtacaatcaaccaagtcctgctattgatagctcagacattgtgtgtggaggtcccaggaaggaaagtgtgggaggggaacctagcccagctggaaaatctaacacgaaaaaaggctggcatctggaaccagcccctgttcctagctgagtggcttccctctttgggcctcaccagtattgtgagggtgttagctttccctgggactacctccaactctgacaagccaggcttccaggggatccagggaagtgtcgttgaggcctgtggctctgtggggtcgttcagggggaggtgcggtgaagtccacattgtccatggagttgtttgggggcccttcttccccgcagtggggctgccctctgctggtcactctgggggacccctgcctccatttttcccttccccacacaccccactgggtttggagtgaaaaaggagtgaatgaaaaaggagggcgctctacaccctttcttttgtcttagagtgactgctcctcccacaaccccaagatgggagagggagatggtgagaagagaagaaccaggagagggaaccagccgatcatccccacccacctgccccagagggtgcagctcaggcctctgcctgtcctgggcagcctgcaccgctgctctgctcagctccttggattgaggagatccctattctgccctaggtggagccccacaataggtctctctgaagtcttttcccctctctggacctaagtgtcttaatctctcttaaacaggaggttgcaacactggcctccctgattccaccttcaacaggatgggactctatggcttcgaatgtaacccacatcagtcttgctcctaaagaatctgcccttccacaaatcaccaacccctatcccgccccatgtcaccccctgtgctccttcccaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttaggtactgccccgccccctcccctggttccccagtccccgccagggagtccccagaggtccccgtgggtcttcgtcccctaccagagccctcagggcatattgagcaagtgccttcagtggctacaacccagggatagcaccagccccaggccccaagtccccaagatcctcctctccaaggcatcctcatcctcccaccagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggagtgcctccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtggaacagtgtatatggcatattattatttgtcgaagtaaaattttcacgaagataaacatgactaaga

SEQ ID NO: 1927 - DNA, 3714 bp, Homo sapiens; identical to SEQ ID NO: 1926

SEQ ID NO: 1928 - DNA, 1460669 bp, Homo sapiens
acaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactcccagcccaagtaatcttttccttcttgtgttctatacttcaaattctgcgtttattcagtgggtagatgtggacttacatagctaacatactggggtttctactgaagacctggttatattttattgccagccactgaaatgaaaggaatcaagagaataatgggaaaagtatatgaactgtgagtagggcatcaaaagatagaggatgctgattagctaagtgaccttggatgcattacctagcctcctcgtgcctcaggtacctttcttgaaaatgaagaagttaaggcctgcctggctgtctatctcatggagatattggcagagcaaatgaggtcatgttcagtgtatgaggtgcccagaaaagagatgttggttgaatgcaaagctggcttttgctgctctgaatctcatcagcctctcgtcctgctccaacccatggaaggtcttccctctgctgtttctgactgggtcatcccacaggattctgccctttctccccagcccctgtaggactatgtcttataagggcctgatgggggacttgtggtgcagtgtgggacatacaaagtgatggtggaaaaacccagtgtcccctcaattttttattgggtgatggagtgggatgatggtgagattgtgaatagctgagaagatcttgtttttttgactcaggaagtgtaagcatacaaaaaaacaaactcactttctcgtactatatattcacaacacagtacttctgtgacccctggccgtcaaaatgtgtgaggatttcttcccaccaagcaattctccaatagacaccagctgggtggcctctaattaaatcagattctgacactgtctacctggagatagtgtccagtcctacaggttaagggctcagtcccacaagacggtcctccacttcagatgtcagttacaagtagtaggttgccaactgtgcttctgaccaactggctataaatcggggattcccacaatcccctccccagatttgattgatttgctagagaaactcacagaacttaggggaacgctttatttacatctacccatttattataaaggatattacaaagaatacttatcaacagccagatgaaagagatgcagagtgggaggtaggtggggaggggtttggcgcttccatgccctctccagcacaccaccctccaggaacctcgacatgtccagctgtctggaagatctctgaaccctgtcttttggggtttttgtggaggcttcattacataggcataattgattacatcattgccattggggatcaactcaatctttagcccctctctgtttcctgcaggttgggggctggatagagctgaaagttccaaacctctaatcatgccttagtttttctggcccccatctaggagctatggtggagtccccagccactagtcatttcattggcatataaaagacactatggcgattccaaggattttaggagctgtatgccagaaatggcattttgggagggggtataggaaaatgttggggtggagagtgaggagttggcaaagaccaacaaagaccaaatatgtttttcacactgtcacagggggctactttctcgtcaggagcaggtggcactaagagatacagaacagataaaaatgaggctggctatgtacacagatgaagtataatgaaaaaggttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttctccctccctccacaaatatttatttgtaccttgtttgtaactgaagataagcacctctgaaatcaggcctgttggcatatgtctaaatactctttaactgagagacatatattcaaagaaacgtttttatatgtccataaactgacacatagattgtcaaatccctaataacaaggttcaaattagaatcctgacactaatgttttcaaatgttctaatacaggtcaccgtttttcctggtacaactcttgtgagtcttatgtgtgtgcatgtgttcgcatgcaactgtgtgagatgctttgttaattaacattgtgaagctaagtgctcagtgaaaaaagtactagagaattgcatattgtccttacagaattgtttgtaaatacaatcaagtaaaagctgtattgaaagaggtaggccttgttcagagccatgttactaatctcaagtctaggggtttgctctgagtgtcttggtgtcttggtggccacatggatgttcctttactctgcttattttcaacacaagaaaggttcttgcaaagatgccttggatgaaaaattctgctgccatggctggtatgcaactcattttgcatggatgttctctcggttctaacctagtttgtgttcaggtaattctggtaatgggacatttgcctctcccctgggggaccatttttagtgtctgtccatccaaccagttagtcagagaaaagagccctgatgtaagtagagaaagaggtatttgtagaactgtgggaaaaagaaaaacataacacactgacctgttttaagagtgcagggtgggttcaaggcttttttaaatttggtttcccaagatgttggggtcactataagcttcgagaatggctgaggtccaaatcctaaaaattactttcatctcagaaaatttgattagcaatcagaataattgaagtgtacctttccagacactatttcctaaataaaatgtatgcataagtgaagtcagacctgatttaagatgaatctttcttccattgagcaggcagtgctttggggataaagggaactggttcccaactccagctttgcattgaactgctgtgtgatctttaaatttcctcctaacaaaatgaggagagtaatactttccccatgggcttgaatgagagataaatgaggtgaagccccaagcacaatgcctgttgcagtgtgttcagcacatggtcatttgctttccttttctaggaaggaagcccggcttcctggtcttctgctgagcttaccctgggttcccagaggctcctttggatgccttgatccatggatatcttctaagatggtcatgataatgtcagtcttcaaagtagctgctttccctcctctgtactgcagagaccaggcacatacagaggccgaagggtggctctgtctcctagggtggctgtcaccaggtgccacatcattctgtgtttatgggtttgctctgataagcagatgaggggggtgctcatccattttttaaattcaagacattcaagttcaacgtatgagacaccaggagtaattgtactatgaactgacataaactgcaatgaggaaagaccttctctcttcccctgtcttagattgcacgccaggatgtgataattaaagcatctgtctctctccagctccccttatcagacatcttaatttatttacttgttaaaaactaagaggagaattcatgctttgttggttttcctctttattctactttcattgttacatattaagtgatctcttggcaaaacgaatacataacatagctataattaaatataattctatttggtatggtgtttccctttcaaccattggcagttcttctaatgacaatgaccttgtaatttaaaacatatcctaggggcatctgtttttattctggactactctgacacattggttgaggaatgacaataacaatggcaggaattgggtacaagtgcagttttgttacatgtgtatattacatagtagtgaggtctgggcttttagtgtatccatcacctgaacagtgtacactgtgcccagtaggtaatttttatccctcatcccctcccattctcccaccttttggagtctctaatgtctttattctactcggtacacccacgtgtactcattgttaagctcccacttgtaagtgagacatgctgtatttgactttctgtttctgaaatagttcacttaggataaatggtctccagtgccatctatattgctgtaaaagacatgatttcatttttttatgtctgagtaatatttcatagtgtgtgtatacatatatgtatacatggtgtgtgtgtgtatatatgtatgtatatctcaaattttcctgatccagtcaccagttgatggacacttaggttgattctatgactttaactttgctattgtgaatagtggctgcaataaacatatgagtgccagtgtctttttaatataatgatttcttctcctttgggtagatacccagtagtgggactgttgaatcgaatggtaattctatctttagttctttgagaaatctccatactattttccgtagaggttgtattaatttacattcctacagtgtataagcattccctttcctccataccttgttgttttttttgactttttaataataaaatatgtttttctttctttcttccatgatggtgcacacataatagattatcaatttactcttacatattaattatattaaagatacagatgcatactagatgcaacacagaagaaagatgccttgtttctggccatagatatgacagagagatcaataaaggccacagaattctcttcctgtttattcctgtggttgttgttgggattttttttagatatagcaagtactcagcaaatttttgctgaatacatttacttagaacaaagggacactggcctcctccagccagccacatattattttatatatattattatgcaaaacacagttgttcagtattgcccctttgcaagatgctccttgacctttatctaagggaattaactgctattattattactcattcttttttatgctgcctatttatatattttttaaacttgaaaaggcgagttttatttttatttatttaattaattaattttttttttttttgaggcagagtctggctctgttccccaggctggagtgcaatggtatgatctcagctcgctgcagcctctgcctcctgggttcaagcgattctccagcttcagcctcccgagtagctgggcctacaggcacccgccaccatgtccagctaattttttttgtatttttagtagagactgggtttcaccgtgttggccagactggtctcaaactcttgacctcaggtgatccgcctgtctcggccttccaaagtgctgggattataggcgttagccactgcgcctagctgaaaaggagagtttttgatgaagcacaaatgtgactagacagtaagggaggaggctgttgggatgactgagaaaagaaataaagagtgtcttagaatcatataggtgagagaattcagaagtcattactgtatacccattgaagggattagattctctgaaggcttaaactagacagtctgacttaatctctctcttaaaggaaaagagttgtatttttgttcttcatgcttttaaaattatacaagaaaaaataaaagcaaaatttataaaagcaatttgtatacattgtaaaaatattcaaatatttacaaaacagcatgaagagtaaaattatctcctctgagttccattctctaaggataaaactgtaaaatgcttcaattcttggctcttctgtttactaccaggattctaacatactttcttgttttataaaatttagacagtagattctgactttttgctatgagagtttagggccatatacgtaaatgctatcttccactcatcattcctcctccgaattctcagtcgtattcttacttatccattatcaaggtatattaacattcacattctgttccctaaatgtaattagattttcacatgctttatagttgattctaaagagtttgtttggatagaatgcctactattcattttttcattcatttgtttatttcattcaacccacactgagagactattttgtgccaggtatgagcctatgtgcaaagtatgtgcaagtgttcacagaattgtgtgtaagacaattgaatgagttttgggcaggagaagatactagatgcatatctcaattctatttctaaagatgtattaaaagaaaatttagatgaaaagggttacggagaaggacactatcatacttttagagaaaaagcaccctggaaattgtttagatacctaaatattgtcaagtattaaataaattatggaaaccagatggattggaatcagagccattaaaaattaaaattttgagaactattaaatgatgtgataaaatgtcataatctagcaatttaataaaataagaaactggatatgaaactagatctataatattatcccagttctgtaaaattttaaaaagatgatatgggaaagaaatatcacaagtgatgacagagatttaaggttttttgtttgtttgtttgtttgttttttgtttttgttttgagacagaatcttgctctgtcgccaggctggagtgcagtggcgcgatctcggctcgctgcaacctctgcctcccaggttcaaacagttctcctgcctcactctcccgagtagctgggacaggcatgcaccaccatgcccggctaatttttgtatttttagtagagatggggtttcaccgtgttggccaagatggtctcaatctcttgacctcgtgatctgcccgcctcggcttcccaaagtgctgggattacaggcgtgagccaccgcgcccggcctaaggtatttttttaaatttttatttatttattttttgagatggagtcttgctctgtgacccagactggagtgcagtgacgcgatctcggctcactgcaaactccacctcttgggttcatgccgttctcctgcctcagcctcccgagtagctgggactacagatgtccaccaccacgcccggctaattttttttgtatttttagtagagacggggtttctccgtgttagccaggttggtctagatctcctgacctcgtgatctgcccacctcagcctcccaaagtgctgggaaggtttcttcctttatactcactttcaatgaggaagtgttatcctaactacaaaacaaacagacaaacaacaacaacaacaaacctattgtcttcaaaaaaataaaaagtaacaatagaatcattgccttcaaggacaagattctcaatctggtgaaagagacattttaagaagttctcataatgtaaaatggaataaaatcagtgtctgagtgtctgtacaaagggataaggatggagttttgataggggtctgggcatcagaaaggacataacaggttgcatcatgaagactgagtagtatttctatggacagaggagaacattcctaggcgtgaagggatggaaatgaatgttgagaagtgagctatctgaaattgctggactagagtgtgggctaaaagatgtagaaaagaaagtggtttaatggcttgtggagaaccttggatgctttgctgaagaattagaatttaattgaaaggccatagggagctatggagaaatttttaaagagaggggtggacttgacctgtattttcagatgcaaagtaaagagagcaacctttggcaccagacagacctggagtcaaaatcccagctctgccagttccttaggataggttcttagacaaatgagttaactcttctctatttccttatccattaattgggggcagtgatttcaactttacggtgtgaacatgaggatagaacaacttaatacagagtttcaatatcatgaatgatgaataggtcttttttaaaggtaagaaataatacctggtgatgaaataatctgtacaacaatcccccatgacacaagtttacctgtgtaacaaacctgcacatgtacccctgcacttaaaagttaaaaaaaagaaaatatttggatccacctatgacctataagctctctctttgagttgttctgcctttccagactgaagtaatgtatgtctcacatgtattgattgatgtcttctgtctccctaaaatgtataaaaccatgttgtaccctgaacacctgggtcacatgttctcaggacctctcacgactgtgcctcatgccatggtcactcacatttggctcagaataaatatctttaattaaaaaagaaatatttgcaggatctcaccccctagtctgtgttaaattgtttctattataatgttaaatatttacaactatatttgttataaatttctcaagtttcgtgctctgctacaggtataaaaccaaaacgagtttaaacattataaacaacacaagcacaataaaattaaatgaagcagtattaatttaatagacccatttgtaatcaatatgaaaataaatctttgtggacgatgtgaatatagtactaactgctacagcccaggttattaaagtttggcctttcccatactctgtgtgttatgttgactcagtctttccccacttttctctactccaacttattgtttatgcagtgaacagtggtattatttaaactttgcttagcatgaacacatcttctatgtatcaggtccacctctcttcctcactggcccatcactattaacatctcaccactgtagacatgcatgcaagtgcaagcattgaaactgcatagcaggactcaattatgtagtggttatctagatgattttaaaaatgttatcagtatgaaaatttagatcacacagacatacccacacagacacacatacacacacaccacacaccacagccctcttatggttctacacctcctatttgtaaatacatatatcctagaagtcttattattattgttttgttgttgttgttgttgttttgagatggaggctcgttctgtcgcacaggctggagcgcagtggcacgatcttggctcactgcaacctccgcctcccaggttcaagcaattctcctgcctcagcctcctgagtagctgcgattacaggggcccgccaccatgcctggctaatttttgtatttttagtagaggtgggatttcaccaagttgggtcttattattattgttaatggcagctttattattgttagtgatcttggttaggtagatgtatcagttggctattgctgtgtcataaagcaccccaaaattccgtagtttaaatcaaccagccatttattatttctcatgagtattaggttggctgtacacacctgctgatatggtttgggggcataatggggctgtctctcatctttggtcagttgcacgtgggcttgttggctttgctgatgtggctgagcttcctcacatctttgaagccttgtctgagatggtttggctttgctccatgtgttttcttcacctccagcaagttagcagaggcttgtttttagggtagtctggacacattcttatgctgatcacagagaagcagggaaagaaatggataagtgcaaggtctctttaggcctcatgttagagctggcagactaccacttctgtggcattctattgattgaaacaagtcacaaggccaatccagattcatcagctggagacatagactctatagtctatttctagatgagagaagctacaaactcaaaattcaaagaatatggttatacgtatgtgtgaagaattggaggcacttttgcaatcaatccagtagagcagttaagaacattgaaatctattaggaagtgacatagatcttcttggtgagagggatcctgccttaggaaagaatgaatgtgtgaggtgctctgccagtctttggtgtgggagtgagggagagggaagagtcaaagatggctttgaggaacctgggcttgggtgactgagaagatggtaaagctactgagatgagatggtcagcaggaaaagtaggtttatattagggggcctggggcatgggagaggtcaaagatggagggagaaaataagtttagagtttagcaaagtgggactcttcccacaaggagaaaccttctccacctagttacacaataaaatcgcctaaagagcttttaaaattgataattgagtctcatccaaggccaattaagcttaaatttctgggtagaaggcctggtattttttttaatattcacaggaaatctaatgtatggcaaaataggaatcattatctaaatcagtgttcttcttgtgcccatacgttagaatcacctggaagccttatgaaaaatactgatgcctgggcctcactaccaaagaatctatttagtgagtctgggatagggccttggcatctgtattaaaataaagtctgtctggatatatgtgatgtaatgtaatgcagccagagttgagaaccactgacctagatagttaattttcactgtgaataatcaatgttttcagggttgcaagccatggcaaaggggcactatgacaaagtctctttaagttcttggcaggtccagaattagcatgaaattgctgggtgccaactggggcatggggacaggagcagtcagaaggtgaattctatacacttcgaagacccaacctggatcaacacctggtgtttgaagcacaagggcttgttagtgctaatcctgcatcaagtagagatggtgggaaatcgccctgaaaagctctatagtgtataaaatgtcatgatgctattgaaacccctgttgtcccattcaaaccgagctttctttacagtagcacctgaaaaatacaacttccaccatttcctttgagaaggtaaattcagtctgagatctcagtatttgttttccttgattggaaagctaaaactgcctcttccttgattttgtcccgttagtctgagctttgaccttgttacatgttagataattccttgatatgcttgttgttaatgccttataaatatttgcagaccaattatctgtctataggcagccactgagtcaacaacagaatatctgggtttttttccatgttcataaatcattcttggcagaccttaatcatttgggtttttggctggcctctctgactttcttctagtttatttttatcctccataagcctcatctattttggagaaatatttaattgcataagagagaagttgactcctgttaggtatgacactgacaatcttccctgggttcagggtttcttcagagtggcatgagaatccctttggggatgggagaaggcttgtgaaaaggacatatttatgagtcccaccccagttctctgaggatgggactcaggcatctggaattttcacttctttaaagggtaggtgattcttatataaacagttttagagctattaccaaagttattgcttcaaatattatacttagaggagaagttggggcaatttcttttctcggtgggagaggctttgctccataatcctcgtcagtaatcaagagatacacctttccttaaagagtttccaaaaatgttctgcatgaggaatcaccatttcatgtcagtcttgtatatcagtggggctggttggttaatacatatggattgtattgtgttcatctgacattaagatataagctgaggcaaagtgaagagaggaggaagaatgaatacaatagataaatagtaagatagaaaagagaagagaaatggagatggggaggaaataaagaagagatatttgtgtaaatatggtttcatctatgacaatgtttagtatcacgcttttttacattttgaagcactttacagtataaaaaatccttttatatgcgatcctcacaactgtcctggggtactggaccaggtaagtgttaacatacccatttcacagatggaaaaattgagacttctgacagcaaccttccgaaggtcagatagctagtgtcaaaaccaaccctggaactcaggacttagttctaaagcaggaattttctgccaatcctaatctatactcagcctgggtaacctagacttgttcttgcttgtgtaatgacaaggccttcattctgaatgagtgctctgatgtgatttgatgtagagtggttctttggggagggacatggcactggcacactgaacagagtggacttggtatcctgaggaggtccttggaaattctcataaaaatcaacaagcttattgaaagagctcatgttacatcttataaacaaaataaaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaacaagataaattcagggcctgatcaccatcagacattttcttggtctaacctattgtggccaaaggaagggaagtctcactcaggtctgctccctctccttcatttacttactgagcaggctttttttgctttagggcatggttggtactgaccctcctgggactataataaaaactaacctgggtaccagggttgaatgttgatgagtttttttaccctcgttatttctcttgatcattacaacagcctggtgatataggtaatggtaatatccaggcataattacgataccattggtctaggcatacttgtataattctgtagatcagctacccccctagaaagtactaaggtaaatttatgcacagagagggtgaaacaatgcaaagggacactctattgctagttggggcttaggcccctcaaatactgaacaggattttggtgaactgggctgcaccacaaagagaagctgggtggacttgaaccaacctaaaagaaaagtcaaacctacctttctgattttggttaggaagggaaaccaaactctgcatccctgctgagaatccccgaaaaagaaagtggctgtaaaagatggaacctaagcctttccaagccagaattctgtgctttgtaggaaaagacaggcatcagaagagaaagcctcaaagagctttgaagagcaagatagcaagatctaggacacagcttactgtttgaggcctaagttcccctcagtgttggaaactcccactattatggccagatgaagtagttttgcctctttcttggtcactgtctttgggatgtggaggtggtgtgggggctggagggaaaatgtgatatcctggggatatgttttactgtgaggaacttaaggatcggggaagttaagtcacttactcaaccaaggtcatttgtttagtgtgtggggaagctcagatttgaactcttgaatcttggcaacaacatttagtaattttcccattttgctacctatcctctctaccaaacaccattttgttcttatgtggaaaattggttctaccctcctgggcttcctctggcaggagcagtgtcattaaaacattgaagagaacccaaagaatatatttttctccacttaatgcttgctcagggaagacatccacatccatgggagttgtctggctcacagtttaggaagtgtcatgcacatggaggtagtctgctagatgaggcttagatcacatgtctatttcatctcactgttcctccttaaaagttcagatgatacaaatggccacactgtcctctaaaagaagcgttggagtttattttgggaaaggggcctattttaagataaaggacaggggctccctattctgccactgtgctggcttgtctccactccacactcagcaaaaatggaatattctctaaacaataggtgactcagcctttgcaaagtctcaggtgaaatggatttagccagcaaagagagaaaatgtctttttttttttttttcatttttccctggtcctgtttgatgataattctcagtgctcagtgctcctttcatccaaagatctgtaattaattaagcctcacaactcccctggcaagtagagagaggtacaaggatgttcatttaaaaccaatcctgtttgatacagtaggactgttaccaaggctctttaaaagaaaaacctttctggccgggcgtggtggctcaagcctgtaatcccagcactttgggaggccgaggtgggtggatcatgaggtcaggagatcaagaccatcctggctaacatggtgaaacctcgtctctactaaaaatacaaaaaattagctgggcgtggtggcgggctcctgtagtcccagctactcgggaggctgaggcaggagaatggcgtgaacctgggaggtggagcttgcagtgagccaagatcacaccactgcactccagcctgggcaacagagcgagactctgtctcaaaaaaaaaaaaaaaaatgaaaaacctttcttttgtgaaacttctttttaatggactaaattaaaaaagaaagggaagaagtaactttatctgggatacctgctgagttatggccacagacagagtcctaagttaggagctctgatgtcattcttggattaaactaggtgtataagctactgctatgtagcaaatcaccatgaaacttagtggctttagacaataataaacatttattgttaatacagttactgtgaatcaggaattcaggagtggcttatctgggtggttctgccttgagatcatagtaaagatgatagcaagggctgcagtcatctgaaggcttgactggggccggaggatccacttctaagatggctcactcaaatggatggtgagttggtgctggctgttggtagaagactaattctgcatgtggacttctgcaaagggctgcttgaatgtcctaattatgaggcagatgctcccctattacaagggacccaaaagagcaaacgtgtaagtgtcagtgtcttttgttacctaccctgggatgtcacactgtcatttcctcaatgtcctgttgactacacaggttagctctcaacattatgggaggggcctacaacaagggcatgaatatcaggaagaagactcactggaggcctgcttggagcctggctactgtatgaagacatattaaacgtatgtccatctgtaatattagtggtcctctgaaaaaccagcttagaggactaattatcattcatctgataagaagagagagtaagagatagggaatggtgtaattaactttctggttatttgtagttttagaaaaaagagccaccattcttcatggttaagtgattaagcctatattggagtgtacataacaaggggtgatgctcccatttttaggagctggatagctgtcccagaccttatagcagatcactggctcctcattgttggtccatggaccaatgttatattaactgctaaaaggcatccctgaggcatttattaaaaatgtggataccagctttctactcttagggattctaagtctgtgcatttggaacccactgtgctggctcaacttatcaagttatgtggggtgagaattatgacttatggcagttatagtcatttgcttagcatctctccatgatctttttcttggtctcagaacaccaactaaaaataagttcctggttgctaagggcatgaatatcaggaaggaattgatagttgccaatgttgtttgcataccatattagttcaagaaagtgcagagagtagaaagttccctaccataagggctactagaaaggcagagaggggatagggttgctgaccaatagcaacagtttggaagattatcattatactgcatcaatatatgcaaggaactggtctaataccaggtacagaagtacttttgcatcctgcatacattttagtccagtggttctcaaatattagtatccagaagaatcacctggagagtgtttaaaagtacagatctttaggtctgcctctgggattctgattcagtgggtctagtgtaccccaggtggttttgatgtaagtgatctgggaccacactttgatatacactgttgtaggtacagcctaacttaattgcaaggtattgacttcatatctatttaatctccagtagcaagagtttaaccgatagagtgggtgacatataaggggtacatgaatgacagttgctaggtgaactgatgacatgcatgaggggtacagggagactggacaggtgtgaaaaagcattttattagcattatctttgtggatattcccctttcagatgataagctcttagaggtaggacctatatgctatttaattttgcaactcccgcagaggttagcatggtaagctgcttgcatcaggcttacaatagatgtgttaacacataggggcaagttcatctgaagtggccaggaattctgcctggttgggaattgattcatggtacccagagcatgttgcatgttgtgctgactgctttatgactttcgaagttgagtgactctaggttattgccaagctctcctctcacctcttccctctttctttcaagtatctcaggtggtattgatagtaaaacagtcttggcattaatgagtgtctgactggagagtgaaatgtaaataagagttgaatagagcacagccaaagcctacaaattaccgctgacaaataacagggcagacaaagagtatttcagccttaccaaacacctctgctacaatcagctaagaacacctgggaatgtcagggtggcagacacagagccaacaacatgatcaagaagaggacatttgatggcaaagagcaaagcagcaagttgcttgtgcattgcttagagaagaagaggaagaagaatgatagaactactggcttcactcaagaataatttattgaacttctactatgtgccagtacttattataggtactagagataataaggtataccaagtagacataaagcttatattttagcaaaagatatagataatggataagcaaatacttagtacatagtacaatgtcacatggtgattagtgtcagtaagaagaataaagcaagggaggggaatacacagtaaaaataaagtaaatataattcccaatgacattgctatatataataatttgacaaatccattaaactaatacttactgagtgcttactatgtgtcacacagtattgggcaatggagatacagtgataagacaagttttgtaatttcacagtgcctaatttttttaggccaggaaaaagactataaacaaagaaagacacataagaaacatatgagatagtgatttgtgctatctagagaattaaggagaactggtagagtgactgggaaggctgctttagtttggttgagggaattcctctccaaggaggtgatattaaattgaaatctgaatgacaaagaggagccagctatgcagaaagcatcacaggccaagtggggagggcacacgggtgaaggccctggacccagcagatctaggaatagaaaggccagtaaagctttataaaccatgaggggctggggtctggttagaataattaagaagagaaataattttttgtttttcatatatatgacctggggaacaaatataaatcctacaaaactatctttctttccatttaaatattgtctagttctttcatcagagacaggtgtaatatttaagtcaattgatttataatatgaatttcttcctgtaattagttctcttttccccagcacccctgagataattcaaaatgcagggcaagtgttattataataaaattttatgttagtataattaacaaaaataccatatagcaatatgccagtcattaagcgtgttgattcatgtagtaactgggaattcttagttaatatttgtctgcagatccatttatcttccataacaccttagatgaaatgtttctttttgggctcgtattcaagatcttggggtgatctttttctgtgtctagtttccatgcaatctgagctctgcagcagccagtggaaatgcccttagttgtcttcagtttctctttatgggtgctgcaatctctttaacccctgtccatacaggaactttgtacactctgctgtattctccatctagggttcacatatcacccaaattctcttctatgtctctgggaagggaagcaattctttttgcaggtcttcactattgtctttttcttttttccattgctttttctgtgctgtctggagaatcactttccataccattgggtcttcttttccccagttaatataccagagcctttctgctcattcattctctacatttcatgcctctctgaagtattaatacctttctctttacactggttacagatgtatatgcaaagatcaagtggatagattgtgtttgctgagaaactttagtgttgaaaatgcaatgcaaatctttaatgtaagtttactgtatatttgagtgtattgtatatttattctccaatataaatttagcaactttcacattatgaatcactaagccttatgtttctccaaagaagggagcatgacttctcaaaatacaatattgttttagaatgaaaatttgtttcatgaccaatgcaaatcagttctgaaattccaaactccctcagccttgaataactttaaaatgcaaatgctacccataaggaacaaatgtcttttcaattattaaaattgaatttcaagatttggtttcttatgataaaaatgtttgaatatatctgaaaaatctttcttaaatcctactattaattaaaaaggataaaagcagaaagttgcaggcaataacaagaacaaagattgagttacaaaaactagaatgtgtttaattttcatagaagttctaaggcattacattagcaccattagggtagggaaacaggcttatgtctctctctgtctcacacacacacacgcacacacatacacaggctaacgggaaaggacagactcatgtacacacacatacacgcacacatagttgagccaatatgctttatgatctgtgaaaattaggctcaacatagtgaccgaattgagagacaggatgttgatcatagttttgctttctaacttgaagaatatagctgagaagccagggtttaatggttttgatattctggaaaataggtatcatgatagtcaaacgtttctgctctgttgggatacaacagaagtatgatgtctgtccttaggaagtttactagtgatttggggggaaaatggctttatattatacaactcaaacagtatgagccagtatacgcttaagcactagatactgcagtgcacagagacaagtagttatgagaatcaagagaaaggaacattattaatactgtgtggggccaacatggaatgcttcatggaggagaagaagtttaacttaatttggaggaaaatacagaatttagcatcattttctctttaatgatagcaagtcatttttattaataatattgattatctctctgttgactcacagattagaggatggaaaagcatgacaaacccacagggtaactatgttttaaaggtttttaaaaaagaagtcagaaaaaaaagagaaagcctttctaagagcctagtcttggggaaaatgtaggagatgcagaagagaattaatggctaatgcttatcattttgtacaaaataaccttgacacaaatggggcaatttaaagaagggtaagtgactcccagcccactcaccaaggttgatggtggaaataatcatggggttgagggcagactggaaaaagaagaccgagggtaggtagctttctcttctacattatgtgtgtttctgatctagaggtaggaagctcatagctgaaggagcattttagaaactcagcctcttccactttccaatcactttaggtacttaacttgatctagctgcaagttagatgtgtctcttttttttccatcctccttcaagctctatgcagagatgtgttagttgtcatatcaccaacgtccaagaagttatagtgaacaaaacacagttagagaactaggataattgtaaatattttttatagcaaaccaatgtgctacaatatgtaagttagggtgtgactatccctgtgcttcataagtgagaaaattattattgctctaagtcagttttccatcttggctacacattagaatcacctggcgaactttaaaaattaccaatgcccaggaccttcccccacctgctctcccaagaggcatagtgagtctgagaagtggcctgggcattggggtttctaaagctccccaggttattctaatgttctgcaaagttgagaaccactcctctaactgctgatataaacaaagtgcagctggagagtttgttaaaccacagactgttgaattccatcggcagagtttctgattcattagatctgggatgggaaccaagaatttgtatttctaacacatccttgggtgatgctgatactgctggttctggggaccacagtttaagaaacgttgatttaaactattgaggtcaagacaattcaggttgtacaaagtcagcatttcgtaaggtttgtccccagaacatacttattaaaatgcagattctgggcacctccctaaactcactgaattagaatgtccaggaatttgcaattttaaatgagctcttccagtttttcttttggacgctagtgaactatggtggaggttaatagttttatttcttatcttgctccaaatattattttatataagttgaatgtgtgaccctatgaaggtttttgtaattattttatgctatattttgtgtgtgtgtggaagaaaacctctatagattggattgcattaggtaccctgaggaatatcagtagtcaaatttggggaaataaggctgggcatggtggttcacgcctgtaatcccagcactttgggagagcagggagggcaaattacctgaggtcaggagtttaagaccagcctggccaacatggtgaatctctactaaaaaatacaaaaattagccaggcatgatggcagatgcctataatcccagctgctcaggaggctgaggcaggaagaattgcttgaacctgggaggcggaggttgcagtgagcagagatcacgccatggcactccagcctggatgatagagtgagaccctcaaagaaacaaacaaacaaaaaacccaaaaaagaaatttggagaaataagcttcgtcatggggcttatattataacaacagactcacctgtttatatagtggctgcaattctcattgcatctgagatgttcaagaggtaactttcaaaaccacacttggcacattcaacataattaggtaattgcacacagcacaggttgtataaaggttagaggagcatctttcaaattttagaggatattaaaattaccaggggtatttgttaaaagttagattcccaagtcagagctccagagagtcccagctctgggtggcatccaggaatctttatttaacaaaagtagattcttatacaatgggtccaggaatctcattttaagaaatagtggattggagaatatgaagtataaaaattgttttcacagttgacctgagttgctaataaacaatttgctatatatttactatttttttcacattttgtaagtcagtgtcctaatagctaggtataagtgtaggctaaaatggcaatgttcaggatacatcctttaagggtgtaatattattacatacatctgtctcctttctcatttacatattgtgcagctttttttgtccctttctatactattcccccttttattaaaaaatggagcagacacatgattaaaatgaggaccaggtcaagtttgcatttagctaagtattcttcccctttatttccctgtcttggccagcttactgtcattcctctttttccctttgttcttttgtctgtcttttcccctaccagtccatgttccatctttcctctacgttgtctctcctttgtgacctctttctgtggccatttcagtgggcatgaagggaaggggtggtcactgtaaaccttgccaatccatatttctctctccacagccaggtggtggtgtagaaagttagtaaagaataaaaacctacacaagtcttctattatattctggtgtgcaagtgtggggttaatagaactgaataaaatgatttttaactaaaactcagagtccacaggtaagagggagagaggtctggacaaaaattgtacaaaattttgttggtgaatgatagtctctgtaggggaacgctgtgcaaaatgagtcttaactgatttagaatatagctggacattcttatcaagttaactgtccactgttttgaatcacaggggctaggataggattatttctttttctttcatgtttcggatttccttctacctgcgaaaatattagctttcactcaagaatcctctcccaggcagaaagaaggaaagaaagtcttgctagaggagaaatcttattaaggctcatggtgattcaggagtgacagccggggctttttcaatggacttatctgctgtcacagagacccactatcctggaagagcccaggcaaagtctgagggttttgaccatcaaaatgaatgactgcaatatgttttgaattgcacagacaggaggagaagtgataggtattctttatggaaaatcacaaagagaaagagctagcaatcttcaagcctttttatcttcataccaaaaacaatatgaatactttctatggagaaaaattgtggcagcaacctgagctgaacataactacaaacagaaaggatatcccctcctacagccctcagagtcatctggcattttgcttatcctgcccctgaactcaagactcttttatattatagagttcttttaggaaatatttatttcttgaacttccccttattttttagggtatctccccatctttttgccccaagagcctgaatcacttgagcaagatataatatccatgtagataagatgataaagggattccttatatcaaggagtcaactaaaagttaatccctgtgaaacacagaaacccaccacaaatggtaaaatcccaagaaaaagttttgagttttgaccaaagagctaatttcatttcccacaagtgcaaaactttggatgtatttatatcagctgactactatatcttttctcaaactccaaagcccacatagctgatatactcttgtcaactgatattgtttccatgttacagatcaggaaacggaggctattcaaagttactgtatatgcgttgtctaagtgctatttgtatacttgtttatcactcctttgatctgccccattgaggtagacaatgattcttgctacttcttggctctcctatatacccagggctatcctgtctcataatagaagcttgataaatattgtcaaactagatcatatgctttgtttgagtcctcaaggggagacaatgaaatagctggggctagaccctcctctctctctcagacatcttgaaatgcagtcaggacgtagcggtgctgagcccattataagacctcaataaatacctgtcaatggcttgactgaaggactgattcaagactatcatattctttagtacttgtctcatgtacttcaacaaggactttagactaaactgatttgattggttatatttttagacttgttacttctgttttgacagaaagaatagacaatacgactacaagcatagtgaccttctggatttgttcctgtggataatcttaagataatttgaaggaagtttcttaactttttaaaggcacaggtgtcagaagtgacaggcttgataattagtcagcattaccccctcactccttttaatgttgtttctcacgctttgcattggttactagtcaatctgggttgcagttctgatttagatgtcaccgtactctgctttaaaggttattttggatctttgcctgtctttgatgtgttctagtacccatcttcctgtctccatccccagcatctgagaacacttctcatttccccactagattgtttttttaaatttttgagcatgctctgttttattttctgattatgaagggcatttctagtagtcctgggaagagtgagctcacaaaaagacagctagagaactagtgatcatgactattatcacatcaagactttggcttaagcaaaacagaacaacaaaaccccaaaaaaccccacaaaactgggaagtgcttagagccccttctacgtgactctgtctgcatctgcagtaggaaagtttacatttactgttaatctgctgttcaactttttgggaatgaattagcaactcttaaatttctctccatttcctatttctagtaattagctcagtgtcacagctaaggttttcttactgacttcagcatggagacttagcagttacggaaaggagaggctagagctttccaccaactgcatgtcactggtgactccaagagagaatccaacaaatcaactactaataatccttactatttaaaccgtgttcactattatccaataacttggctctcagttatatcttcttaagaattctaataaggcatttagtttatacaaaggaggagtctgatctatgcagtggacatgagagacaaccaaagttttgttcctctttccaatggcatagagaaaaaaataaaatttaggcagaattagaattcagaatgcctgggagttcctccagccttgggaaattccaggtgagaggggaggactctggagctttttaaaaagaccctagagttcattttacccaacaattttatttcataaatgagaaaactgaggcctagagaagtatggcttaccaaggttacaaactaaattatggcagttttagctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccaggaatgcagaatgttaatgcagctgcggaataatacactagtgccacagagtttaataatagataatgacaaataatacagttggggaattgtgtaattcaataacagagtaaatgacaaggaaacacacacaccaatgaatggttctagtggggacgcttaggtgttttcaatttaacttacctctccagccctttggcctactacccttttgagaggcaggcaggacatgcagagatgtgcccagctggggtttttagtttgtgcagtgaagttgcaggtttcaggggctgagtcaggaagtatgaattgtgctcctgggcagttatcagctgatccctttaatgcatgtattactttcctccatgtcatgactggatagtttctttttttctgggggagagggggcctagaattgtcccaggttggccattctctcctattacccactctgtaaatcactgcatatgagggagtggtactggaacatggagcttgaagatgggaagagactgggagttggggtttgggtttagggtcataatgggaggtaaaaggtttagccacagctatggtttagtaagcataccagtgatctggtgtgtacttccctgtcctcagctgcattagagaaaggcagccgctgatcactgttagacctgtattctttctctaagagaatgggatatttccctctcattcttttaaaataagataaaaagcaaggggtggggaaattaattaatgtcagtaaatgaagcatgagacacttgtccggatatgataatgactgtgaattagtgcagaataaataaaatggtataaaaaatgaaccttgccagcacactcctttgggatgggctcagtcacccttataatgcattaactcttcccttgcctcatccttggtcctgtctatgttactgtgtcaaagctcccccactgcagagtctcaaggctacagtattatagcctgaggtgcccaaagggagccctggctccaggagagattgagccagctggtgactgcatactttataatgtaaatagaataacttcacatctatttattaataaaaccacactaaaaagaagcaattgtgtgtcccccggttgggagattcaagaaggcagacagaaagccactggaggaagaaaaagggataagttcctcaaaataagttgctccctttcccccagagccaaagtttacctttgtgctgctggtaagttatctacctcccctctctacttttctgtaagggccccaggctgtatgtcttttatatcgtcttcagatgactacaataaacacacactaattgggcacttcctgtgtccaagcactgtagaataaacagagagaaataaagcaatctccattttcaagttttctcctttaagggtgtggagtagtgcttgacatgtagtaaatgctcaacaaattgttgctattacatcagcattgtttcactgaatttaatccctatgaaattttcactgaagacaagtttgagagattcagagagcccttggccactttattttctttacttttgtttctttgctttccttttctccttcattttcttatctcttctatgtttcaaagttcttagattattggcaaagcaaatgcaaagaacatggttataataacctttgaatgttaacacttaagaaattatttgctattaacagaaactcaatgcagtgtagtcaccaaatatgaatcactgaattcagaaatgttattaattcacactacagtatgggcaggtagacaagtgtcggaatactagtttagagttgtttgatgacagcttatatctttttgtattctcatcagtggtgactatatttgcagagtgatttggaaataataacaaaagattgaatttgtaatgtttggtattttcttaaaatactctggaaccacaacaaagagagggctggatgaaaccatgtggacaattattgttgaagctgagcaataggcttatggtggtacttactatttttgtgagtgtttaaatactgctataataaggaaggctaaagtgttgagggatcctttgggaatgtaagcctggatgaatgacctcctggggcctacctttttcctgcccctccaagtccaagttgggaggtagatggtgaatgttttacattcctggtgtgactcaacataaccttttaaggacagtgttaacatgagatgcctcctgttcctttgggaggtctgtaatttttctcagaaggctaacttatagtccaggtatgtgtgcactctgcccattcagtctttgcctttggtttttctttgatctggaggatcataggaggcaagtgtggaaatacttcttcctggagacaatggcagaggagagtccgtgtatagaaattgatttgttaacccttgcgatggcctccctctcccaccctgggatggtggaagagatgccactgagagcctgggcttgtctggtgaaagagtgggcttaaggaaaaagcaacaacaggatcacaaatgagaccctaaatctggttttttccttgtcctcagtagcttattagagataactacatcacataagctctgtccatgactgtgaacttttatggttttgtctattagagggtgatgtcagaggctgttatcactggcattaatgatttatttgggcacaggtagacttataaaagtaggtgggggtattgattatagtcatgggccaatgagattctgtttcatttcctaaccaccaaacagatgtaaaggacttctgtgtgcagacctcaagattacacagcaaaggggcttccaaaggaatttacaatttgaatgagacctataagaatcaagaggtgcccaagagcagacgtaggcctgtatgtccccatatggttgagttttgataatccttcatttccagtcactgctatggtctggctgaccttctgaatgtacccagtattggctggctttagatctatgatatgagctatttttttactcattaaagtgtttaaatttctgtgcttagtttctcagatgacttttttttctgtgtggaatctggttgatatttttggagaataatttaaatcagttctaattccaccctgaagagctccttttgacacacaagtggctttgtgtcattgcaactctggaggaggccagggcaggcttcctgggtgctcagaacactggctgcccttggaattatggctttatctctgggggatagtacttcaagaaaaaatgccaaggaaatgtttgtcttagtgtatttttgtccattttgcctcaaaaaagatttgtcctgcccaggagcagtggctcacacctgtaatcccaacactttgggaagccaaggcaagtggatcacttgaggtcaggagttcaagaccagcctggccaacatggtgaaaccccgtctctactaaaaatacaaaattagccaggtgtggtggcatgcatctctagtcccagctactcaggaggctaaggcataagaatcgcttgaacccaggaggcagaggttgcagtgagctgagatcatgccaccacactccagcctgggccacaagagtgaaactccatctcataaataaataaataaataaataaataaataaataaataaataaataaagatagatttgtcctgaaacttaaagaataaagactcggtagacatggaatatattttttttcaaatttcaaaatgcaaaagagaatacaggtaaatacttgtatttacttcataaatgccctatttttcacagggtgtatcagtgtgctttgggctgccatagtaaaatagcacaggctggaggacttgaacaacagaaattcattttctcacagttctggaggctgtaagtctaagaccaaggtgccagcaggtttggtttctccaaaggccattctctttggcttacagatggccatctttttcctgtgtcctcacgtgacttttcccccatgtgtacatccctggtatttcttcattccaaatttcctcttgttataaggataccagtcacactggattagggctcactctaatgacctcattataacttaatcacctctttaaaaatcacctatctccaaatacagtcacattctgaggtcctgaaggttagggcttcaacctatgaatttgggtaggaggcagggacacaaatcaactcataacacaagatgaggaatattgttaaatgataaaaacaaaacacttgatccctatgatctaaagccctgctctgcaattctagagattgctttagaagtttgcatttaggtatagtcgtaacatcctagaaattaatttagaaagctgcttttacattaaaaatcaaaaaggtgagcaaaaagaatcatggctctgtaaattttcttttattttgatatttcagaggacattattactattactaaaatattgtgggtggggggaaggaaagttgggagtaggatgagaaagaatcaagtgttgagggaaatttttcatgtttgttggaggaaaagaaaagacatgaaaggaagaaagatgaaagaaagagggagatggagaaataaggcaaaagaagagaagaaggagaaagaaaggaggaggaggatgaagaagaagaaaggggagggggaggagaagggaggaggagataaaggaggagaggagaagaaatgaagagggaatgggaggggaaaggtggagtggggagtgaagaggagaagggggtggaggaaagagatgaggaaagggagaggtaaagaagagagagaaattagtgtaggtagcacttaccatggattgaaaaagagagttcacgcttttccctctcttaggaaactcccagctgcttctaagaaaataagagtgactacatcagagagatgcaaacaggaagagaaagtaaatggaggccctggagagggagagcttgggtattgaggtttggtgtggatagctgagaaccatccaacattaatgagcacaaatgtgtgcacaggctgaaaatgtctctccagggacgctgatgacttgagctttgtgtgtgccattggaaatcatgaatgagaaaataactgactcgctctctcagacaatctggtttatggacctgaagctcttatttgctgtcaggttgttcatctccacgcctctgtgagatattattgaaacagaacccagcactgtcctccttgccaaagtggttgacgttggccttaactttccccagttctgagacagggacagactggctaatgtaagtgtgccctgtggatgtgcaatttagagggaggaatgggaaagtatgttgtatgcagctagggacgcacacacagaggatattttcactgattcctctctgtgggcataactactgtcttgaaggcctttgcttttctggttttatgatttccaagcctctttcctgaatcttagaagtcaaaactcaagctaagctgcaacagaaacttcatcttttctcagaataaaatctattttcttccccttcccatggtaaacaaattatgttgacagacaaatgagggattaggtgaggaaatttgtgattttggaagctcagggaagcagatgtcaggattcagctgagagggaagaatttgggcggggtgggaggctacatggagaaatcagaggcaatcaggaggtgctgtccaagatgaggcatggtggtgagatggataaagaagcagtttctaagatgccactcaagagctctctggagatttacagagagctggacttttttttttttttttgagacagagtctcacgctatcacccaggctggagtgcagtggcacgatcttggctcactgcaacctctgcctcctgggttcaagcgattctcctgcctcagcctcctgagtagctgggactgcaggcacatgccaccatgcctggctaatttttgtatttttagtagagatgtggtttcaccaagttggccagaatggtcttgatctcctgatcttgtgatccacccacctcggcctccgaaagtgctgggattacaggtgtgatccaccacacccggcctcccaaagtgctgggattacaggtgtgatccaccacacccggcctgagttttctaaacttctgggtaaggctgtttgactttggacatgacgctaggcttaactgagcctctattttaccttatgcacagtgggcatactccttaccttacttacttcacaggttggctttgaaaacaaaatcatataggaaaaatattctgaatatgctgaagagccagaaaacatagtattatcactttcttggttttgctgtacccatgtatgaatcttttctgcagcatccctgctgcatgcttgtttctatgtccccatgtcctgcctcagttgaatgcatctggtggtggggagcttactaccctttaaggaaagtcattgtttaaaaacatgtatatataatttttaatttttacagaaaaatgtttgcattgagcccaagtctgcctaataataatagcagtaagctaactctcatgtaaggtatactctgcagcagacccactttgggaactttacatatattaacatttattacatttattattcttagccaccctataaggtgggtactgttattattccgattttacatgcaagaaaaccaaggcacagacagagtaggtaacttgtcctaggtcacggggtaataatttttacctgctggctcttgtttttctgtccatagctgacccaaaatatttgatgaccggtattttgtcctctttgagtgctccctttgccggtctaccatctcctttcccttgctttcttctgcatgtgcctccttctgaagttttcccacagcaggccccactctccaagggtgtttcgacctattcagaaaagagttgcattgctgggtccccttggacctgctgctgccggtcggctgggaagagttataaagaagaaaggacattttcaagctaagctctcctggaaactggtaggatggcgtgagctggtccacaggccccagctgccagatgatgggaattgggatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaatgaagcgagcgaggagtgaggcagagaggaaggaagatttgcagacaagcaagcctcccaggagcttgttggattggaatgtattctcaggtctattgtagagacagaaattccagatttagcattctgtcattgtcagaataacaaattaatatgtcttatgcccacacaactacatatacgcaaatatacaggcatgaaacggaatatctggcagatatcatgtattttataactctttggggacaaagactgtgctgagaattcatttttatactgatagagaaccccagctccccacctccaaaccaaacacataatctccacatcacatagatgtgggcgattcaaattgctttctcctgtcaaaaggtagcatctatgaatcactaagtagagtctatgaaattctcagttgagaatgtgtctataaaatttcctcctttcttacctttttaaataaaattactaatttctctctcaaatctgactgtggaagccttaggactagtgggatattgcagaaagaatgtgacgtttgggaccaggaaggtgctgagattcggattccgcctctgctgcttaccatgtgggcaacgctgactctgggcaagttacttagctctcttagcctctgtttcctcatgagtcaaaactgggaataaataataataaccttttagggttgttttatctctatgattaaacaaaataatagatatgacatacattatgggtctatcacatgataaacgcttaagaacagagactccttttactttccagttatccaaggtatagagtatgagaggggcaggtggctgtgcagtggtacatcttagtgcataatctctagatttttggatttttttatattgagaagtggactgccaaaatttttgttaaatgaaaatattttaaaaataattaccgtcaattaacattatttcataaaaaagacattctaacattctaaagaaagccttcaaaggagtgtgtgaaaattaaataagatcgtgcatataaagtacttaatagtttatattagttcctagctttgataagcattttaaaaagcactaggtatagtttttagatatattagttttagtattggtatagtataaatgttaccataccaagaatcaagtccaaaatctctaacatgacatataaatgggtgttcacacacacataagccatttgtaccccacaaccccagtataaagctatttacagatacactctactccagccaggggtcccagatataaacacttgtaggggctgggtggataatatcattaagtaacatagatagcaggtaagaaaaactctgacgtggtgttagtctgtcttttatccttcattgttgttttaaacatggattcaagctctgaataataataagagccaacatttataatggcaaagaagaatatcatcttgctatgtgttcaagctaagcatatgtttatgtgtaagcatagctttgccaagtataaaaactagtttggaaatcctgtatggactcaatcagcttaatttttacatttttaaccctctgattttgtctttatgtttatcttcaccagttctggttctgcatagaaagtctttagaggaatgtaccctttccgataatgcttccagatccaaaggatgcctcgaaagtgaccaggaattgctacagatggttgacttttacccagttgccaacgttcttctggggatgctgtgcgttttgtgtcctcatcccaactcctagccacttcaggtttttatagatgatcttcagacaaaaatagattaagaattagccaggaggggtcaggcattgtggctcatgcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaaagttgtggttcttcatcctgctggtatttaatggattcagcttcatataggggatactagcttggaaggggagatacttagagaaaaaatgactttcagtgctatagcaaaaaggaatttaaaacatttcaaaagcccccaacctcagtacattccaaagcaggataaaataaatacaaacaaaaaatcaacacctacaccaaaccaggctaatataaaacaaaacctacttaaggtccagatttttttgtcccagcatttaaaaacagtgccagcatggactgaagtaaacacgctgcaatgatttctcagcttgggaaactgtcctttcttatatgtgagatgcctacagaggaagcagaaagatagtaatttctttcccttgcttttctgggagatggatctcagtgtttttgtcccttggtcctagccattttaaagagactgctgccagaagaaccacttagcacaattgtgaaaacctagtccccatccatagcagagatgctttcctttaagctgtactttttgagatattattgacatcaatatttgttaaaaccaaccttcgtggagctgttgctatgtaaaatatattacacttaggtcaccaagtcattagtccaatataggtatttggaagttggtttttagtcattctctttaattcaaatggaattagggtcagaagaaatgttcaagtcctaatcacttagaaacccatatttggcgtgttttgttgcttgggtaaagggagtaagacctcatggcttgaaagaatcctaccagaggtgttttgtttttttttttgtctgatttcctttttcaaacttgataagggagtaggcaaaaaatgtctgagtcaccagaactggggtttcacaaatgaatggtctcgctgtaacctaaagtaagggttgaagtgggggaagatgaaacaataggtggctgtagcactggaagaatatttgcagccccacaaactaatgtctgaattacttaggatacatccctctgtctagagccagcccaaaaaaatatgtgattcctgccctgattcagatagagatatctccaggctacttactatatgtatttattatgaagtacatgaataaatcgccacccaaatacagtaaatgcattggtattaaaaattaacacagactttttgttgtctgtcatcccatcattttctctttaatgaaataacggtctggaataccacctaatggcctgagatgcctcagagtgaggtgtgtttttaccaattctttaacttaatcagactggcctcttgatatggggccaggttcttctgagtaactcactctgaagaaaagcaggatggattgattcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgtgaagttgcatgttggtacatacttgagatgtcactatagcttttcttgccatttttcattccatttctactgggatgagcaaaattgacagcttctagacatctggaaagaggcttttgatcttaggaagtgaagtacataatcatggccaattttacctatgaggaagataactaagtggtttctcaaatgccagaataaaaaaatgacttcttgtttttcaaaacaaggcatagagatcccaatagcaacacagaatgtttctgtgtatcagagcagaaaaaggggaattgaggtagcattggttgaacacacactatgtgccaggctttacactaatttgcttgaataatttaagtgagtaacagaacaatgtttccactaagttgcagcaaaaactacacatcttagactttccttagtgacatctcgaatcttcagggaaggtggggggtgaataattgaaataactcttgatttcttatattagggaccaggaatatgcccttgataggaaatctgtcatttggaggtcattttggccctttctggaagaaaaggagacattgagtgctttgaggttccaacatcaccacataccagttagtgaaggtgacagtcttctggatctctgaccagcaccagggctgttggcccttgttgctgcccccatcagtctgaacagactcttttcccaaagaaatttgctaaaatgacaaatcagttatcactgtctattaggacatccactgcatccatctatcctaatatcttcctcacgtatgcctcagcggcatgttttacttctatttactggtaccacagtcttagcaaaagtagcacattgattataggagttgtgaagccttgagccctgacaaatggggaccacattgaagaaaatggagggacaagatactaatacaatttccattaatgacctggatagagtccccaggcattgcttatgtatttaatttttattctgattatttttaacattgtaggcagaatgccagaacgccaaccatcttagcttcttcaacattatacagtgaaagccagaggggaaacctaactcatcagatcatagttgacattgggggaaaaaaataaaggtcagcctacaaaatttcttcagactttgattaatacagttgtagatttgaaaaaaatgttttatttgagttttcttcctacatattttgagtttggatgtaaaatattttcttttgaatttggaagaccacttctctaagaatggagagttaattagatgattttcttttctttctcattggaaatgtaaaccgtgttcatttattcaacaaatattaattgagtgtctgctatgtgccagacactgttttaggaacctggaatgctttcaggaacaaaaagagaggaaaaaatatccttccttttgtaaagtttacattttagtaaaaggagaaagaggcaatgcaataaacattacaagtaaattccttttatagtatgttagaagattatgagattataggagaataccaagctgagcagggtaagaggatagaggtgctgagtaggaggataggtgaatccaaagatgaaggggttggttatgtcgttatttggggaatataaggccagtacgtctggaatgcagggaagagggagaagttaactactgggagccagagcatagtaggtctttttggcccctgaaggactccaacttgtactttgagttaaaatgggagccactgcagagtcttgagcagtcttaactcatgtgactagcatgagttaacttgagtcttaagatgcttgtgttggcctctgtaatgtaccaagaacagtttcttgccctatgattccagttttcgataagttatgccatcacttgctgcaaaacagacctcacccaccatgacactgggccagtggctatttattcctgatgaggcattgtaggatctagatcaaactactgtttcttccaagcttcctgattgcacattttcatggaaaaatgcaagggtatgtggtgcctaggaaaaggacagtagaaacggtaatacattttactcttgagcataagttttgattaactttgtcattatttcaagccaatatagccacaaacataattggtggttatgaaattatgcaatcacactgtctgaggcctcattaccctttaacttataaatctgccttgccatctttccatgatcctcttaaagaatgtacctacccaccacctacataataaaaaaagccacaagccccagccttgggggaattgtattgatttataaagagagaggctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctggaattaaattctgcccattactttagctatatgaccttaagtaagttttgttatttgagcctcagcatcttcctctgtaggatgagaatggtaatcaaatgtatcgaagagttgttataaggatcacaaagttaattaattcaagtccttttcattttgtcccggaggaatagttttagtagtttgagtttgcattcaatcatctcccctttcgctttttcatcagtttattcctttgcagttcatccagcagcctatcaaggacctagtatgtgttaagtattatggagacggggatatttttctgagaaatggaggctgtaggtgtgtctctagcacctaacacagtgcttggcacatggacaatgccctgtatatatttcatggaatgggtgcaactccctgcccttgaaaagtgttcagtgtgtctgtagaagtccagtgccagatgggagtgtcactggtgcagtgagccagggacagggagcagagaaagaacaattgagaatatcagagggagatgatcctccggctgcttctgctggcctggacatttgaagggatttcttactgggactggctcttttgttctgtggtttgtatttctgcctttgtgcgaatgacttgtctgacatttctgggactccatcctgatatgcaggccagacaggtgggatcccagtagggaactaggtatgcctttctgtgtattccaggaagagtttaaccttgggcagacagggctagtctttttgactttatggtatgtttaatatcaacacctggttgggggtagggataataaatgtttggcttacaggacttgcagctttgcaagatacagtggtggtgcatacacttatatttgttatgactcatcttagtgcaaaggcaatggagtacctctagaaaaattgcacatttaaggggataatttcagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactgcaggcatgaaccactgtggctggtcagctcatagctccatcttttattggtcatgttaccttgggcaatgttgttagcttctctgtaccttagttttattgctgtaaaatggttctaataattacaggctacctcattggaagttgagaggattaaatgagatgatatatttaaagtgcttaaattcttggctcataataagcattcagtaaatgtgagctattatttctctttctcctcctcatttttaattttttaaatactacctctattactattgtgaataatgtcattataaaggtgcaactagatcatgtttatgaaggtaggtaattgcctagcacaggcctggcacagataagcactgagcaaatgttagttttctttcacatgggtcattaaagtccgtctgtaaagtctcagggactttctcatcattttccctaaacctaatgcaagatattcacatttctttttgtgcaaagaacaatcttaattcagctgataatcggggcctcccttaccttcccactgctcactataacagagaacaagtactagctcataactttttatgactttgtattgaattaaaattataatgctttattagttatcttttgctgtttaacacatttccacaagcttggcagcttaaagcatcacacatttattatctcatagtttttaagagtcaggaatctgggcacagcttagctggatcctctggtttatggtttcttacaggttgcaatcaaggttttagccagggctgagttctcatctgaaagcttgactggagaagaacctgcctccaagttcacctggttgtaagcacaacttcattcctggagtgttgtgggattgaaggtgtcagttcctagctggctgttcactagaggctgccctcagtttcttgccgtgtgggctttcccatcatggcagcttcaccaaagtcatgagagagagagggagagagagagacagagcctgctaactagatggaagttgcaatcttatataaagtaatcacagaattgataccccatcaactttgctgtattctgtttgttacacacaagtcacaagttcaacgcaaactctaaaggaagggattatgtaaggatgtgataccaggaggtggggaccattgaggctatcgtagtctgccatagcatgcctgacctgtgggttgtcttttagatgctttattttgcctaattttattttattttttaacctcagttcagagaattcaatttattagaacaggtctgaatggtacagaggtgctttaattattcagcagaattctggaaattttaagttttctagaaatgtatagttttgctttactttttctccccttataaatagaaacctgtccttccatgaatgaatgctacagtttcagagatgctttgtttttcccctgattgattgtcagtgggcagtagcctctaataaagggaacagttttaagtttccttttcttctcagcttctctgttaaatggttaatgatctggaagcaagtacttggaggtccttagggagctcctatttaaaggaacactgtgaagagaagttgccttctacagtaaaaaagtggggatgattagtcctccatttacatgtttagtaaatctgaatatttagacttccacggataccccctgccaacccccgccaaatagatgagctgaaagtacaggatagtactctacatgcatctgactgagaaagacttttactatctcaccttagggtcctaagagaagacagctggatggttgcatggcggtagaggtgtcaggaaaagctcccttataattattttcattcctatgtttctactcaatactatttaaactgaaatggggcttcatctgctcctttgtttattcagcaaatacttttgagcattttttatgatccagctactgtgctaggtgatggggttacaataagatacagtcccagccttcaaaaacttatgtgctcaaacgttattctccaaatctttattctgtttctcatctatcattaatgggaatagacagctcattttttattgttcttggaggctagagagtacaggcaaatgcagatgatcaagcctttcttattgccccactcctagttgattccctctccctttcttttacttatgacatgcaacttccacaaaggcagtttatgttagttatctatggctgcataacaaattactgttgaacttagcagctaaagacaaaaacatttattatttcacagtttccatggaggaggaactcaggcatacccttgctgcgtcctgtaactcagaatctctcagaaggttatcattgaggtgtcccctaaggctgcagtcatcctaagggtcgactggcaaaaggtctgcttccaagctttctcccggttgttggcaggatttagttcctcactggctattggccagatccctccctcattgcctcaccgtgtggacctttccatagagcggcccatggcatggcagcttgctttactagagagagcaagtgggaagagccagagagttataaacaagacagaagctatagtctttggtaagctaaacttggaagttatgtcccatcacttttgttgtattctattcaaaaaaagctacttactaggtctagcccacactcaggtggagaaggttatacttgggcacaaatactaggaggtagggattgttgtgagccattatagaagttgtctaccatgggcagaaggacatttcaattctggaaggtatctgatatggagactcttaaggcacaatgagttacccgtgagctacctcttgtacattcatagctgtccaccctttttatattttctgtggtatcagcacagagattgggggcagggggtggaagcatggaataaggaattagatgccaaaactaagaattttattttttacaaagcgttatcacatattaaatctggaaaggacattagagggccttatgcaaatgaataaactggcctagagatcttctatgcagcccccccagggtctgttctactgcagaccctggatctcctataacagaactataacagaacactggatctccacagaaagccacaaaggcccagagatgtgttcgcacagatgtcatcatccctcttctagtccctgcaggagcctcatgggagatcacgtgaccagtatttcacagctctttcccccagcacagaaatatctgccgtgttgagaggcctgtccatctcctagtccctgctagagcctcatggacaatcacgtgaacagtatttcccagctccttctcccagcacaggaacaccctgccatgttgagaggctcactcaagagcctcatgatctgcctgctacctagcaatagctttgttacataggttgattctgccttgtgcctagaaaataaatcatgtttaggattaataatagtttatataattaatatatgtgccatgcttgagccaacacattccatcacttatcttcaggctggctgcctcctgggagccactaggtctcgagctgcaggctgagcatgctgggtaacaatgctataagtctgcttactggacccagtcctacagcctatgaatattcttttctgtatttgaatagcaatagctggagatgcacaagtcttgataaaataattttacatttgttatattcactttttttcttgcctgtcaaaaatgtcagcttttactctctggcttgcaatctaaatggacccaattttaccttagctactttgatatgatattagctgcttagggcaattgcaagaaataccatacaagggttaatctccctcacccttccattcctttgatatgctgttggaaatttcaaagtgctcaaacacggagatgaggaggcagagggtaaatggatacagaatggctgggaaagggagtagcagtggttggctgctcttaagatctctctcccatggcctggtgccatgagtctgtgtccagtgtgatttttggcaatttctacattctatgtgtatttgtgaagtactgtttttgcatcagatgatatctaaggataaattttgtgttagaggagtgtagttacttgggaggaaagcagtgccatattattttatattaaacatcactggcagaaatatgaggatgggtaaatgtctactgataatttaatagattttacctgcctaaatgacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaaatcaaagagaccaggaaggaaaggccaggagaacaacagacaacaggtgaatatccagaaaccagcagattctaacaggcaagaggtagaggctcaaggggagacagatgattgattggcttcagagaggtctggtaggaatctaggttgtcagctgggatcgtgatcttcagaacagaccagtgtggggcaagcccaaagcaataacttggggtcaggcatgaggtcagggcaaggcagtgggagaattgtaagctttgaggtatgtgtaggttaggggcttggtcaggaccaccatcagcaggatcaggattagggctcatgggtcttgaacttctttcattcttcctgaccagaggcagggctagtcccagggcctaggacaaggctaagcctgaaggtggacattatgtgacaaccaacaaaaggaggaacatcatactagagtcaccgtatgtcctagtttctctaggacaggcccactttacatgtgttgttccagcatgataatcagtggttctcccctttcacttgaaagtgactgacttgcgtgataagttacatagttaccctgattattttccagaatgtgtttcataaaaatctttttagaagaatgtcatccagagaccacaaaagtagagttctctagtcacataagtatggcaaatccagaatgaaaggaagtttaatggaggagtctttactgcaggatttctcactgcctttatatgctaaattataataggaattgctaagaggggaatagagttcttagtttcccatccttggttgatctatttgtacactttggtactcctgagactacgttatgtggaacacactttgggaaaccctggttagttgaatatggggtcagaaagggaaactggtcattgctcctgctgtaataagggtgcttgcaaagacagcagtcaccagttaaataaataattctggaaacaacaactgcagactctgacaaaatcttcaatttgctgattattgactgacattagcagaggtatatgtgactagccctagctgagtaactttctgaaggatgacttgttctctagctcattggcaaaaccacttactacttagggcatgggaagaaagagaattttctttgttaagtctttaactccatgatgttcttaaaggagagatgaatgaggagataatggtgtgtatgctgtgtctctgtgtatggggaaggggcctcaggaactatgtatttttcaccagcattccaggtaattctgataaaggtagccctcaaaccatttatggagaaacatttcctgggagttctgatgagaaactcatggtgataaaaacccattcatagtggtcatttctttaatcatatgagtcctttgatatgatggccagtgatctgatatttgcgaagttcccactatgtgccacaccctatctatgtgctttcagtgcttaacgtatactgtgtgaaatagtcctcatagaaatttagcaatggccccattttacagaagatgtctaaagatagaccttcaagtgggcccgacttactaggccattccatccgggcccgacaagagggtcacagctcttagacccacccctcagcaactccctaggacaaggacacaatgaggcaaatctctgagcctttgccctaaggttacacaaagctcatttagagccttaacaagcattaagaccattccattacaaacaggaccatatgctgacacattttatctctctgcctggtggaatgggtcaatatcaaacaagctaatccagggagaatgatgcattgatttcctaggccttaccaagtgtgcaggctgaagtcaacctacctaggaaggttttttttttaagatgaggtggaagagagaatacagcaagaaacaaggagaaagatttgctttgcttttgttatggagttacaaatccagacaagtgacataagcagcttcttgtttttagctgggccaaagaatgtttttcttttttaatcttattgaagagccaggatctttgtaattccatcaaggatttcaaactcaaatgcttacaggggcttggagcatgaggagatttagaactgcctgctgggtgggatctatggtgacctaaagaagacctgcctcttctaaaggggactcctgataataatgtattgtatgtttcaaaataaccaagagcaaatttcaaatgtcttactctaaaaatgctagatgagcaagatgataaagatgataattagcctgatttaatcatttcgcattgtatacgtgtcaaaagatcacataatattccataaatgtatacaatcatttatctatcaaaaataataacaaaaaataaaaaagcagactgtgctttttagcattcagagaatagattgcctatggaaaatatggctgttttctcagaaatttcaactttttaaacaaaagttgaaaatctatattttttgaaagtttttctgatttttaaaaacagacttcttgagatataattgatatacaaagagctgtacatatctaatttgatgaatttggacatatgcaaacatcgatgatgccttcaccataatcaaggtaatagacatattcaacacctcccaaagtgtcctgtgctcctttcttttttgtgggtaagacgcttaacctgtgatctaccctcaagaaactttgaagtgctcaataccatattattaactatgggcacaatgttgtatagcagatctctaaaatttattcattgagcctatatccattgaacaattccccatttctccctcccctccagtccctggaactaacattacactctctgcttctatgagtttgactattacagatatgtcatataaatggaaccctgtagtatttgtcctgtgactggcttatttcccttagcgtaatgtcctccagtttcattcgtgttgcaaatgataggatttccttcttttaaaaaactaaataatagtcatgcttggatgaaactttgggttgtttccatatgttattgcgaacagtgctgcaataaacatgggggtgcagatatctctttgagttcctggtatcaattgtttagatatatgtccagaagtgggattgctggatcatatggtagttttatttttaatcttttgagtagccttcatactgtttttcatagctcatactacattcctaccaacagtatacagggggtccaatttctctacatccttactaatagttgttatcagtttttttggataataaccaccctgacaggtgtgaggtaatatctcatatctcattgtagttttttttttttttttttttttttttttttaggagatgggggtctcactatgttgtacaggctggagggcaatggctattcacaggcacaatcatagcatgctacagccctaaattcctgggctcaagtgattctcttgcctcagtctcccaagtggctaggagtacaggtgcataccatcacacctggttctcactgtaattttaatgtttatttccctgataattaacaatgttgatcatcttgtatataattgtaggccatttttgtgtgtttttggagaaatatctgttcacctcctttgcccatttcttaatcaggcttttttcttgttattgagttgtaggcattccttatatattttgggaattatccctaatgttgcaattaatttgagtgtttaaaacattccataggccaaataagacatacagacttctggtcagtgacctctttcacagctacatgtgggtgacgctatgtcactcaaataacgggacactcgtttactgggtgtccatggtgttgcagacatttcataagctacctcatgaagtcctcaaaacgaatccatgggttgaaataatcatgcccatcttacagataaaagtgaggcccagagaaactaaatggtttttccaagttcacacagcctacatgtggttagtgcaggtctgaattctgattggtttgaccagaaagagctgcagatttggggaagttttgttttctctcctctggggaaaaagagtcccactcagggttattccattactacagatggtcactgccccggggccagggccatgccacttttctccaaaggttagtcccaccggtatgtgatgcagttggtggactggctctcctttgattagcatgagcgacgagttagtaattgatcatccacctttctaaggttgccaagcttagatttactatattttgtaaaatcacccttccacgtccttaaagtccacgtgcatagtctatctagattctgatatttcatgtgtgaaattaatcctctcggactgtaatgaaaatgtggctgttagcctctaattaagatgtgtgtatattgattgcagtggtcaagtctgtccactgatatattaaaataaataagcatccattttatattggaaattttgtgacacttcttgagacaccttgagtttctctgagttgttacaaaaccagagcaaagagtcaaagctgtaatttctgcctatcactggcttttgaatagattatgaactcttagaggattgggtttgtatctatatagttctctttatacagagatgaaggctttcacagcagtatctataattgggtgtttaataaatgctttttgatgagggtaatggtatggaaataaagctcttgagatccagagtttgcttggatttcttgcctcattagggaggaaaaggtgaatggggatgcatgggtaaatacgaatgtcaatctcaggtaggaaaccatatgctcttctagcatgaaatgctgaaaagagagaaaccagaagggtgtgactaagacagaaattctgctgattgacactaataccggtatttaccaatcttctgtaacgaggtagactccatttagaatctggtgatgtatcgcatacaagttagattgcttgacaagtcacaccaaggtttactcaaagtcactgccattatggtatataatcacaggctcaccagtgtcccacaagggtgaaggcagaggttaatggttttctttttatttgcattattacttgatctctggctttcctggtgagatgggtttttataagctcttcccatctcactttttgaagtgtttttaagctattttaaggctgttttataggtgccttttcttatgtttgttttgtatgctagaaagtaagtaaagaggatccaggatatgagctattgatactaccaggcacactgaagtaagtattaagtcttttattgagctttctaaatggcaaagtatatttcttttttatttaaaatgttaaaaaaaaaagtggtcaattctaactaactgccctaaatgtatcaaaaggcccttagaagttttcttctttgccaccatggtgaatccttcaagcaaattgattttaagcttgtacaacaatgtgaatgcaatgacactaaagtgtacacttaaaatggtacattttatgtatgtatattttaccacaataaaaaaatagattttaagcaactaatcaactacgaggttgtcagactgattcatagagcatgagcaatattttgtattcagtactataatgtagagaatattactctgttatagtcaagtgtaaaaaatatcatattttattttccttatgttaaatttgggccaggcatggtggctcatgcttgtaattccagcactttgggaggccgaggagggcagatcacttgaggtcagaagtttgagaccaacctggccaacacggtgaaaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgcattcttcccatggggaactttgtaatcatttttctctttgccacacaatggaactctgcgatttggcccttcaccgcctgttaggtttatatgcttggaagtcagggagaggctcctgtaattgacctctctattgaccacagacttggccagaggagcaccttctgctcttctccaggctgcagtgttgttttcacctccagagggacctgcagcaatccttttcacctttggcattgcttcaaaggggacatgggtctctattagtcacagaaactcagcaagatcttatctcacttcagaaagctcatatcctctgagtggactcttctacctgcttgaaccccagcatgcagccagcccagattctcagacaaacctttggatgaagaaagtgaaactctgagtgacaaataactttggcttgtctgccctaagaaacacaaattgttagtgctcttgaaagtaaaggttctgagactcagaacaggatggcctaagatcttttctatataggggaggaaaaaaatgtttttctgttttctgaatgtccaaggcagccagaacatgacaaaattttatatatatatatatatattttggcaatgcctagatgagtattagtaacatactagttgcaagggtagctttagagacagagaacttgggtttgaatcaggttgaagcaggttaagttccccatgcctcaattttccccatctgtaaaatagaaataacagtaatttttttatcatgaatttactataaaaataaattaaataaaaattaatatgtgtaaagtactttagtctggcatgtagaaagtacttaatgaggaagctataataataataataataacaattagttaacattaccaaactggttattcagagtttaatcctctggaactctatgcttagctctaatctcaaggagtccagggaagcagactaatcctcactattaaattttgtattgattctcggatgttttcaaagaatcctacatccacatatctcaaaggagtgctattgatttgatcattttatgaaattcttacccttttgctttcagaattctagctagatgacaaaaaggaaataactcacacatgtaaattaatcaaactattttggaactcaaacattgcttgtggaagacttgcagattgagccaagccctgttctttattaactctggataatttgctttctttgtttgatccctggcctttaagtgaatgtcaatctcttgcttttttcctgaagacctataaggcttgctgactaaatttcatggaaattctttgagattcttagctagaagaggctgtaaaggccaagtgctataggtactaacgtctcattgctaacactgatattttaccttgatagtaacttccaacttgacataaaagcttgtaagcaccagatctttgcctctccccatggttgtatgtgtttgaattctttggagaaaattttatgacttgcatggcttagggtttcataaattataaaaatgttttatctctggtttgaatagagtagtaaagcatatccctgatttctcacttcttccataacccagtgccttcttatttctaatgcctcctagtctgatgtcactgagaagatgtttatggccttgcttgccagagaactaaaaaagaaaacaacaacaacagcagcagcaacaacaacaacaacaaaaaacatctaacaacggagccaatgcttactcatgccagtcccaggattccatatatggggacattgggcgtgttttaagccatatgctcataacctttgtgtcatgattcagttggtgtgtcttgatcagtttcctcatctgtcatctcttggaaagcatgtaaagattaatcacagatatctgcttgtattacctagattaatgctagatgattagcagatgaaccttaacatctcagtggcttaacaaaaaaaggtgttaatctcccacttctatatgaagcccaggtgggagtaaggctgtactccacaaagtcattcagagaaccaggctgttgaaggctctgccatttctagtaaatgacctccaaggtggttctcagcacaaacatctattcacagatggagaaagagattttgcatatatatttttctaattttcatttttgcaaaatgtcataataagcaggtaagatggagcctcagttggagttgtggttagtcatggtgaaacaagagttaaaaggtaaaatcgacagatttcctatcagctatttatccatcattactaagaattacggagtgttaggcttagaaaaggtctaggaattgactcattttcctacttccaggagatctggttctagaacccaggacttccagctcccaggcaaattgaagcgcttcttcttccacatgggacccacttctatgagagcatcagtctgttagggttaagtccaagctctaccacttaagagctgaacaagttatattaactgcaaagggataattttagcaacttcctcattaggaggttgtattaaatgcacaatgcgtgacacacagagacttattgtcattattaatatcccaaattttttaaatggtcacaataattccccttgcaacttctgtcatatgaataagcccaggatcgcttgatggatgatgatgaaggattcatggccaagtcatccacaccacctcagccgactttgagtcagtcaccagacatgtaagtcatgtaagtaagaccatcctagagcatacagccccaggcaagccagcctagatcagaagaaccagccagcctactcacagaactgtgagaatgaccaatgtttgttactttaagccactaagtttggtggtggtttattatccaacaaaggctgatacagaaaggatcacaattgaggagtttatgtgagctcaatctgaaagtttatatgagctagatttgcccattatttcactaaattcatcacatggccccacctaactccaaaagagactggaaaatgtaaaaaacccagacagaaagggaagtaggctccaggacagctggccaatatctgccacactgatttaccttgattttgtaaaaacaaaacaaaatcaaaacccttaggtggcaatcagagtgtaacaactttccaggcaagttctttgggacaggccactagacagtcacttttagtttatttgtttctcacaggaagatagagaaaaggaaatgcgacagatgtgatgccttcctgagaggctgtctggtaaatcaattcctgccaaagttctcctacaaccctaagagataaaaaaggaacctgcaggcgaaaaccacaaggtaggaagagtttgaagctgtgatctcttagaataagagcttttcatttattctttctgagaaggaagtctagggcatctgtcattgagagtgctattgatataattttgctttctgccccgtaggatctgaagcagtcctgccccaggcttagagaagtaagggcaagctagcccaattctgtttgctccagcacatctcatcccagagcatttgttgtaaggccctcttctttttgatcccatgtctacatttggatctctggtctgggaggagaaatctcagaggctatgaatctgatgaggaaggcaacttggcagtgcagaaagcaccctgctttgcagtcagactttccagcttccaattctacctctgccagattaattagctctgtgtgatcttgcacaacttctctaagccttaattgtgagaattaatattgtatttattaggagtatggcacacgataggtacttattagatgttagctatcatcatcatcttcatcataatttgattttgcttttcttattccctttgatcttgcctcctagtctaacaggagaaacattagaagttggtggagacggcctagaaaaggaagggtagattagagagcaggagatagtgaaaaattacagttatttcacaattgaaatcctatcccatgtttgcattgttaattatagttttcgaaagactgtcatctaggcaatctcatttcgcatgaccattctatgagacacaggaacatgcagtctattttggcagataaaaaataaatacatgaggagttaagtaaaaactgtgttactgagactgcagtaacttttataaatcaatgtgcaaaaaaaattcaagtattttggaatgagatttgttggattgaaatattttatggtggtctgtaacatcagctcgtgagctcatagaccaaaccccatcccaaatacctggtgttcaggattatcaatataaaaattgatttaagatccccataattcatttactcctatttcctgacatgcagaaagcttactgccactgggttatttcatcagtttttccccatctctccataactagtctacctctgtatgcttggcttctataacattgcttactggtctttcttaaggcatgttgtgttctgggtcagttctctttaatctgtggccaaactcttgctcagatctaggaatgtgtcatctatgtgcatctttgttctaagctgaacatttcttagcactatacctgagtttctgctgccacctttcatattcttttatgatttgcaaagctagcaggaacccaaagtgactttcataaccaagtgtccagggtctccaggagttcaggttctctctagtaaacagttccaagaccgcaatgaaagagatgtcacagagttgtatatagtataacattaactaatatttgaatgataaattattgccataggaaactagagaaagaaaaagacactttgggatggagaggttagggaagattctgtggaagatgtgagatctgagctgtgttctatggggtagctaggtcgaggtaaaaaatgccatagccaagcgatcagaggcataaatatgcaaggagtcttgggtggaatcacaaagtttagcagatgagtacatgaaggtagaccctttgtgccaggaagtaattttgacagaatgttggagataattttgcctgtaatggtttctgactgacagtttattcattcattcaatcattgagttcaacaaattcaatttattaagaacatactatatttcagtaactcttctacatcccagagatacagcaatggacaggaaaggttctttccctcatgctgattacatcttaagtatggagacaaacaattaaaaacaagcagatacacacagtaatatcgtatagtcatagaactatgaaatgttaaagcaaggaaacacaatagtgactataagggtcaaacaccattgtagagaggaaaatcagggaggaccacttgggttgggtgatatttaagctgagatttgaatgaagaatggaagccattcttgtgaaagatctgggtgattggcattcctggcagagggaacagctaatgcaaagctctaaggtggtaacgagcttggtagagtcaaggagcagctgtcattgctctgtagtgcacttggaaaatatgctcaggtctggtcctactattggcacattaagccagaatctctgagatgaggtctaagccacagtgcttattaacacctctccaggtgattctaacagttagccaaggttgaaaaccgctgtattaaaggaaagccaaaagatgaagggcttttttaagcagacagagaacactcaccaggggaatcaatggaggagggaagtgaagaatgtaactgtgcaggaagagtatgctagggatagagggatgctcatcttcgacctggtaatcaatggaatccagactgacctattacaagagtggggtccctatgctctttacatagtctcccttgtcagtttcctgaaatttattgtgccaactatggtgggagttaaagcgttaaggtttggcttatttgttttgggcagatcacagagatccaggactcagagctagggaatagacagctgaccccaagctggaaaaactttcccagatactccctcctgcctaggaagtggcctatgaaaaagcagtttaaataatggcagcctaaaatatagttctatatgcaacatttttttttctatgaaaactaccttttgccttatacaacctgttaaaaagtgggagatttcactaataggagggcaggagttgagcacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaataggaaaagcagcatgatatagatggaaatctcctcatttctttgacgtccttaacaagaacatcaagtgaggcagaatagtcaagaacttggactctagaatccaaattggatgagcgccttaagcactttaatccacagtttcctcatctttcaaatggaaacaacagtgcctaggattcgttgctgtgaggactaatgacaaattgcatgtaaaaagcttggcacagtacctggcacttagtccaggccccactccatggtattcatcaccagtgtcaaaattgccataataattaacattgcctcaatcacaaaattcatgtcatgttcaccaacagccaatggcttccagataaaagtgagaaggccaatatagagctggggttaaacatgtcaagaattcaaagctatagtgcccctgggtattcaaaaagcgtaaagatttgactaaattcacagccaaatggcatttaccccaggtctaccccataccagtcactggcttctctctaatagttgttatcccttttaattctatagaatagaaaagaaggaattggggctaggctgagcagcagaggagagattggctgtggagagtatagatgacacatgaggccaggtgatctctgagaaaagtttctcccatctgttgcttagattgcccatcttggaactcaggaaatctgagatggctttaaagaaaatgatggcattgagaagtagtgagattgcagggggctttcaattttctgcttgggtgttggtggagagcaccgaggtcaacatccatgcttgcagtataaaattctaggtctgtgtccctgaaaagaatgttggtgtgagctaatgtgaaagatttggggagaatttgtgtaaaaagtaacaacaaacaccaaatgcctagttgagttctctgatgggtaaggtagaatatttgagagatttttttgagaatatttcccactgaaacttgggaaataactatagttaatgaattttgaagaaaagagttagcaaaagagaaagtaaatctgatcattaacattatatacaataaactgaactgggaaccaggagacctgtgtgctagactggattacattgagtaagcaatttgaattatctaggtctcagtttcttcagtctgaaaaagaagggcatgagattatattatgttgaatccatcttttgtttaaatttttgttaaattctatggagtacagagaagttgatggcttcaggcacaagtgagaaagtattttaatcttcttacatttttaggccatgtccaaatcatttgttttttcactttattttatttgaatataatttaggttttctttctcatggggtgaatgaaaataaacactttagaaatgtataaatcagtgtgcatttattggagtatggccaataactttagataatgaaaaggatgattgagctatttaatatgttgatttaagtaatgctgggtgatgagtggtagtgacaaggctcttctcttactaggatatcacatgaacaggttctgtcctaattctgcccttgcctagtacatatgggtgactagaatttggtgagagggggctgtctgctgagctaccccaactgtggttacagcacagttacagagatggatttttaagtacacttgttttccctgtcatttgtcatgaaacagactccctatgctcattatcaaaaagcccatatgctatcttcagttcacattttgctcacctctttctcttcattgcattagtcaagttcagaaactagactgtcagctgccagacaggctgctgtttctctcagagataggtgaaaaccatttaggaattcattatcaaagtgtacagcccaagaaggtgtttttgccttcaattcaattattccaaagaagcacacgataaagaaaagtactcaggacaattagatggactatctagacgtcaaaaatcaaatttttacctttgcaaatgcaggttcatattctgttcttaagtcatcagagggaaacatatgatgttcactgtcagtttagattgtcagaaaaagcttgttcaaaatctgtaaagttgtcactcctcatgtattttcactcaagaaaccagggatccaacttcctgtgcctaaactctctgcctagacaaatggatcttttgggaggttaagtatgtcttagaagaatatctgagctggagttgcaaatagaggaatcatcttttgttaagttgttagaacctagataacatagaagattactctatggggtttgaaaaaactaagacatgatgccctctcatgagacctttacagtctatttggggagttaaggcatatatgcccagaactttattttcagtggttcttggcaattttaaagttccggtagtatagtacaagtacccaaatgtgatgcccacaatgagggctgtggtaagtcagaaaagaggctgggttttggtttcttaggaaatggtaatttacatggagtctcacccacctggaaggattgcagtctttatgtttagcatcactttttgtcatttaaatttctctctaggtggggatctaatccagtccggagttacaggagctagaggtgatcagaaagtgtgcctaatttgacttttgctccatatgtgacataaaatagaaaaaaagtgaggtccccaaagaaaaggtagcttgagaaccaatgagagtgtctctccatgaactgtcaaaacctctgggatccagcagaaacagggtttgatttaagctgttcctgggtacaaaatgcgagctcttacttggcatttatccttgacacatatgggagcaggctttaccagaggcaagaattcaatcaaaagtcaggctttttgaatttaggtctttctcttttcttctgctataaaatggtgagatcatagcccatgccctaattggttcacagatggatacatcctgaggcaggtgggggtaatcctcaagttttcctacaccaaagcataccccagaacaaagaactactcgttctggaggtgaagataaggcctgtgatgggttgtcccatttgatcactgtggatttcctctctgtgatatcttctgctcccctggaatctagtattgaggaaaaataaccttaatcaggaactgtcactcttcttcaaagagtaggacagtcaactggcctctagcctataaagaaatattcctttcagatagactctagtatataatatcattctgctattcatcaggaagtggctgaataatttattatacaacttgtctatagatcagagtagatgaataataaaatctttagtatgtaaaaaccttacaagaaagttgagacttatggtagcaaaggatccagaaggattgggtcattttgtagttattagtaaacatatgtctgtgataaagaccactttggcaaaccgaggtatctctctacccatcatcctgcttcaggagaacttgggctctgataagtatgtacgtaatgatcaaatcccccacatttaccaacctgctccagtcatcattgtggtagatgtgtgcacgagaaaaatgctcattttattccattccatggatacttacattctctgcgtgtttatttaggaagcattttattgaaatgattcctcattatgtgtaacttaataccatttattcattaatttatttactcagtacacattaattgagtacatacaatgtgcctggtgctgggaaagcaaaagaaaaaaccaccatacttatcctcaaagtcatctcagtctatttgtagaggtgaataataaatgactgtaatacatggtgaggaagaccaccattaagtcagaaattgctaaaggagttagcaactaactgtctaagatgattgggagcattcacagagaaggttatatttgttgaggaccttgaaggagtaggagttgcctaggtaaatcaaggaaataaagggaataaatatcaaaggacccacatgtatgaagacacagaagacatagctttagagaagtttagagatgtttgtagagcatgctggaacacaagaaatgcttttggaaagactctgtaaaatatttataccctaatactaggtatgcaacagtgaacatttaaagtttattgaattaagtcaaccaaagaagacccaagttgtgggattcaagaatagcaaggctctttcaaatgcctctgaaacagttgggggtggacctctccatggtgctgaaacatcccctgttcaagccttcctatctatctggattattggctcctttccatgttcctaaccctcattctgcatgcagtaattacttgattgaccatttcactcactggccctgccaggaccttgccttggatactacctgtccaatggtgagcttattattctttcctttaacctgcacagaccctggatgggcatttgatcaactgaaataattaatgggtagaaacagatattgtcagtgaagtcctttaacttctttctgcttgcttttctcccagatattttagcatttaattaatctggatgcaatttattagttgcttgggttggaatttctttagccttttagcccagatcacatatacttattacgtatttattggaattttcaggaaactgtagttcaaggtgaaactttgaagatagactcaaacaatgggcatgtctcacaatgatacagaggactcagataaagttggtggaatagagtggaaagaatactggatttgaaattaaaagttcaaatcagggtttcaccacttagaagctgggtaaagtcatttagtttattttgaagcctcagtatccttatttgtaaaatgtagacaggttattccctgtatactcacaaacttgtgctaagactcaaatattctcatgtttgtgaaattagtttgaaagtgatgcagttgggaacgattactggataggttggaaggttgtccaactggtgcccctcatgatgggaagagacagaacactgcgaattagcacagtgaaagttaggagctgtgaagaccctagggggcagaggaggtacaggcattaatattatggtgctgagaagttaatatctttctttttaaaaaatagctcggcatagaagctgtcagtagggctttctccccggtcagatttatgacttctgaatgacattgttttactttgccatttggaggataaacaaagctggagagaacaaaagttttattttcctatcagtgacaaatacatagcaatcaatgtaattgaagttcaagtggaataatttatgggggatccattgcatgctcctttgtgtactctgtctgtctgtctctctctcttcctctatccccactctaattcctttcaccgtcatttatttctgcctctttctggtattcagtcctgtatatattaaaagcataagccaattagaaaataattgctgttactctgcttggcccatctttcttgatgtttaggttagtttggcattttattctctccaaagaatgtatttattcaaaaaagacatctaccacatttaatgcgggccatttagatattaatcatcaaaggtaaacgatgaagaaaaattttagtctttaattcttttcttaaaagtcacatatacagagagctaattgacccatgctatgcagaagtgctctgcctgaagcccagggttaatttttacaatggccacttagccaattgaggatggttaagtgagcaatattttatagactcttgtattaattattttgggggatggatataagtttgtggatggggaaaacactctcagattattctaggggagatgaatgatatatctttacaaaaacatataaaaaccttaatttcagtgaatggtttataatgtaaaataccacaatgatatataactggataagagggcttctctgtgagtagagcttatctgtatatcctgatgaaatttaaaaaaaaccccatggaatatatgtttttgggggttaacaaaaggaaacttgggaaccaagaaaaaggaaggatgtaaattaacttattgttgtcctttattgtttgaaaaattcttatcataaaggatggtagcccactgatttttaatttcactgataagtgagcaggaaggaataggtaagagatgaagatgaatgatttaggtcatacttcaataaaatatttttactgtttatttcctgtatcacaggtttttcaaagtagagcatttcttatctggctggtatgatttaggcattattttatcactagaaaagccataacgatgaagggatggtatgttcaaagcagaggattaatatttactacatatctactatgagtaagttactatgcttttttacatatacttttttacatatcatttaatcaacagtcttgtgaattaggctattctgacagatgagaaaactgaaaatcaaagacactaagtagcttggtaagtgttacataaccatgatatgtcagagccattaaatcgaggtgtgcctaactctaaattccatactctttatattacactatgatgtctaataaataatttggttgaaagagtcatttttattcaagataggagagtagactcattgatttctgttagtcttttctatgaatctgttatcggaaatagttgactacaattaaaataattcctggcactataacactactagacatcttcatgtcatgtagccaacatctttttttcctttgcaccatataatctgttttctctatgggtaaaaatcacattttaatgatggggtggaacttcctttattccaaaactcatttgtagtcggggttgggcacatatctaggtctgataaatcagaatagcctattcttctgtccacagctatttatttttaatgttttcaagctgattttacctttctgctagagtcatcagggaagatactctctttccactggggttgttaaacaagtagaatgcaaggctagactactagcaggcatccttctcattaattagcgagagaagagcttgtctgaactatggagggaaaaatagagaatcaatatctaacggtattctttaagaccctgaatccagccacacttgaaccatttttctaaaggaatgtgaattcatagtgtttttcttttatcttgggtctatgttatttgattttaaaatatattaaaatctagcaatgttattttatatgtggctgatacattatatatccatagtcaaggagatagcactaatcacataccatgacaatagacacaagtctgatctaaactctgtatagatattggcactgcccttgttttccagattatctctggagtgctctgagggatcagttggttggccaacaaataccatttgtgcctcaggctctttgtaaaacctaggggaatgtctgaatttcccttgattgagacatctcccttccctgtcaagtcctgaaggagctgtaaactcaaggaataatgccaaaggagaaattagtgtctgccttattatcaattgtacttttgttcataactcgcaataatttggttgctgcatagggcttagcctcaaatctaagcagactttctctgcctcataaatcaaatcttaactctaggcagtggtaaaaccacagtgcccagtaatggttagtaaagaatacaagagagtgtaggccgggtgcggtggctcacgcctgtaatcccagcactttgggaggccaaggcgggcggatcacggggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccaggaggcggagcttgcagtgagctgagatcgcgtcactgcactccagcctgggtgacagagcaagactctgtctcaaaaaaaaaaaaaaaaaaaaaaaaaaaaagaatacaagagagtgtgacccatagttcagactactcaagtctatgtgggtctgcttcctgaacagctggtaaacagtggagaaagccatactcaaatgaatttcctttcaatttcagtgcgtcctttcactacaaaacagcccaatcaatgtcctgggttctgttcactcagactgagaaaaagaagtaaatcatccatagattttggcattttgttattatcacaaagtatgctagacatacacctcataagtgattttgacaaaaagatgtgctgcaagcacagtgcttgaggggtggtcacgattatggatatcactgtactaatctcagaaatcttagtgtatgtttttttttgtctttactggatagtttcgtatttctacctgcatgtggagttctgtcagggccacattcttccgggatatataaacgtggagaaaagtccttacactgtggtacagtgatccgctggaggaaagtgctatatctgtgcattttgcaagaagtcattctatagcatgtgtatgtctattaacacaatcactgaaccagagccaaggttccaaagggactatctgagatcatctttctaacccagtgattctcgagctcaggtgcatggcagaatgcctggagggtttattaaaaacactgattcctaagctccacctaagaccgattgaatcaggttcttttagtgtagggtgcaggaatttttttttataacaacttccccaggcgatttttctgccagtctatagaatggcctttggggatctctttatcttttaccttcaagttaaaacacatcactctgaaacttcatgagccagatacgaatctaacctatattcaaagaggtttagaaaaagataccttcaacctctctcagcacaatttttttttctattaagctcccttttcaaaatacttgaactccacctggacctaggcaaaatgttttaaaatggcatcagagtgaatcaaatcacattaacctgagatggtgggcaaggatcatgaaaaaggacagagggaagcctgaatgtgagtttgcctgaagaggaaatgatgattccaataagtgccttttctttccgtttgcattctgtgcgtagctaatccgctcggcataatcctcttaacggcatgtgttccatcagtattttatctgatctacttctctgacaatcctatgtttgctagtttccttgtatttttgagaagctctagatgttacatggaaaattcaaccttgtttctctgttttcatacaaagtggggttcttggaattcttagaaaatggggaggaccctttgcacaggctgaagttgtgtgagaagtctggacagagtttccagctttcaaaatttagtaggggaaaactaaatagaggctttctcccttgtctcaaaactggattttaatttgcacactgctggtatgggtcaggggactgttgtgctgaatcagaggatgtaggatacagggaatcatgaaaataagcattggcccccatgcctaggtgatgagaacatttgtcagtagatgttaaggttcctttataagcttgactattgcttttatttgcataaccaaggaaattagaataagattggggcatccttcatttaccatagataaagacagggattctcttactgtagacccagccctatctgtgcactgcctcctatggggaataatctgagggctaaaatgcatgaccacttgccatggtactaaagtccctcagctggacttcatgccataatcacttcatcccattgggaattcagatccctctaaattaaaatacccctgagatgggtgtaaccttaatccctttatcagcttactctgtaattatcaattaatactttaggagagattaactggcaaaaaatggaaatcaagatggcatttctcctggttttgctcctcctcgttttgttctcctggttttgctcctcattagcagtgtgaccttaattttttaatttctctaggtcctgggttcttcatgtatgcagtgaaggaactaggtgatagaatctttgacctctcttctggttctgttttagtgacagaattcactaaattcacatttctggattcctgactgaaaggggattcataagagccttgcttacttcatggctttcctcattgtgtccatggaactcaggccacatgattgtgggtctagtgaaacaaagagagtgtggccagagaatgaaagccataggaaacctagatagccgcataattacttagttgaaagccttgaacagctgaattccagagatgagtttgcaaaagaggagtatcatatgggatgtcacacttcaacagcagaaaaataggctgatacgatcagaaaggatgccaggccattgtggacatctgccgtgcagaatgacatcaagtggctgtctgaacatagtctgaaatctctctctcttgactttgaagagacccctgggcctcaaacttcaaatctgcaaagatagcactatagccagcaggcctggctttctcatgtcaacatgatgcaaacgtttctgtggatacgggatttggagtcaggaaaactatattccagtgtgacatctagccaaaaacaaagaaaactaacaatgttattgttaactttgagctttcctctactttaagcactgggctaaatgtttcatgtactttctttcattcaaatggtgaccttaggttcttctgtgagtcttcatttctttttcagtaaaaatggagcatatctgctttatctgataatagtaactaacaattaactgaatgcttacttgtgcaccgtgcactagggtaagcactttcgtgcattattatctttgtacaataatcctaagaggtaggtagggatgatgactatttatagacaggaaagctgagttggactaagtgaaataaacagcgatgaataaagtctgtggaagaaaggggattcatattttctatgcttcctgatatccaagtcacccagaaatacaccaaagaagctttcagttttcacacctggctgtatgaatttattccatctcagtgagggccaaatggaagactatttgtacagggctgtgtggattaagggagtgaagtggcaatgagaaacagaattcaagtaatctagagctggatagaaactacttatttaagagagcacttggattccagagtttgagtaaaggctttattgactaacttcctaaagtcaccaagaatatcaataaactaaatttacccctttatttatccttacacctttgtattagtccattctcacactgctacaaataaatacctgagactgagtaatttataaagaaaggaggtttaattggctcatggtactgcaggctgtacaggaagcacagcagcatcttctctgcttctggggaggccttaagaaacttgtaatcatggcagaacgaaagggggaagcaggcacatcttacatggctggagcaggaggaagagatgaagtgggaaggtgatacacacttttaaacaaccagatcttgtaagagctcacttgctacacagtaccaaggaggatggtgttaaaccattcatgagaactccactcccatgatccaaccacctcccaccaggacccacctccagcactggggattacaattgagcttgagatttgggtggggacacagatccaaaccatgtcagccttcttttctgtgttatttttatgtccagccttactgaactttctaagctccaattttttatgatctgaaaaatggggctagtaatagctttaactggctagtggtggtgagtgggaggcaaataggagaattaaataatatagcagacattaaaatattttgtcaatgataaactaatatggatagctattaggcctaatagtgactgtgttgattgctgatttattatttgtcactgatgacaggacaatatctctcttattgagaagaaatgccttccttattttcttcttaaaaagattatcatttgcttattttcttcctcctctgtgaagtaaaactttatcaagaagaattaaacatttaaaaaagatgtgcagtaattggtagggaaggataacgagaagaaaagcagacaactgtctgctgcttagcatatccatgagtgtgttaatttaattagaactgccctgtataaatattaaactcaattcacttttgttatgatcctttgcttttcaaagtattcccagttacagattatctttttcaaattcttctgtgagtttgagggagttaatggaagtaaaacaacccaaattggaatgaactgagagaggttttcatcttatcacactttgcttctttctgttattttcctttgcctagttcctggcccagcggcaaaggaggtgattgattttcagtggttttgcctttcaagatgttggcaatgcaacaacttcccttcagtggaattcccattttgtgtagtattttggggtggaggattgaattgctttacatctccacactcctgattaaatgtgaacccccacctgacgtttccaggtcagtagccaggatgtgggatgtagtgcgggatggttgttttatttgattttccccacaactgtgtgagggcaggatatcattgtccccattttacagttaagagtagagtcagtaaatcacagagccaagcatgtataatttctaacagaaattatgggtttagtacctagattgagattttgatagattcaggataaaggtagtgaaaaaattgcccatggaattggtttgaactgaattcatgagaattatagacttccataggcagaagggatcacttttagagtcttttttcagaatgaggtgagtgaggcagagtcgtgcaagtacagatttggggtcctatctttatttaaatttttgatactttgtttagcatggatatttccattcatttttgtgttttaaatgttgcattaaaaattctgtatctagattaccaattcttttggtacccccttaaattttctgcctgatgcaagtgaggcacttccctcaccctattcccagccctgtatagcaggcacaatgctaggttgtttaccagtcatagccccttatttttcacatgaagaaactggggcctaagatcacaaagccagcaccaataacacatggctcttgactcacagtatcgttctcttcttgctagtggagctaaaataataggagagacaaacgtcaggagattgtaacctcataatagagcctgactaaatgtgccagggaaaaaagtgtagcgtccttaaactgtacaagtcagtttagcaccaaatctttcactcacccagcaagtagaaatagctgcaagttgcagcaggtggaatttagattcggttcaaagaagaattacttgacaatgtgggaagtgaggtgctacattgtttcctagataatggcataaaataagagtgggaaattcaaatcccctgagttgggtgtaaatggtggcaactgtgacaaactggagagagagatcatagtagaaactaagttctatacttaacttgattactagagaagcaatgtcttttctttctttctgggtctcggacacccttttgatttcaggtcaaaatcattttcttgaagtaacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgacttggctaatcagagagataaaagaaagaaagaaagaaaaagctctgccctttgcatgtggcctgataaacaattatgccctccagacaccagggctgtgaattccgcctttttaaacaggcccagagtcagcttatttggagattttcagcaccgtggacagaggcaccaggttactttttatctgtcactccctgaacagcaggatgaagaactactcagtttgggacagggctctcagccactgtggtgaaaatcaccccctttagcagaaggaaatttacttagaccctttttatttcccctttcccttggaaaaattgcattttcagttgtcaaggcacttaggcttctacaagttatttttcaggtgcctggaggatggaaaagggttgccctggaaattgatatcttcttctgagtttggcttaacaggggaaccaccagtgcccttgcggatggctgaggtgtcttttatgctaggtatggctctcttccagataaccaagtgtagacaggagtaggcccagttgttcatggagcattggttttaggacttgacctaaaagctgggtcatactattgccagggcaagaattacaaaagcaggtaaactctgccaagatttttctagtggaacatacacattcatggggatgaatccttcccaaactttcaggttttactgtatttggctgtaaaattcaaaagccagattgactaattctcagtgcctgttaaattcttttaggagcaaagtgatacattgtccccacccctgcctttcctaagaactcattttttcccctactcattagctgtattcaaatgcagagctttgctgatgaacagcaaagtggcttcttgactattgggtctctcactttgtcttctcctggactctgtaagtagccctactttcatttattttctaatctttgatgcctttccttcattttcttgaagcacctttacttttcatagtctgtctctttctttttgccccttttatggccattacacacaaatctgagctggccctcttctcatggcaatagacatcctgggctactttcatgaggaagcttaggacaggagctgatggagattagccaaaatgtcagagttagcctaccctttgacctgggcctggaggtgaggttttcttcttacacttactttggaatgagaaatgagagagtgaagttttcttcctacacttacttcatgtcaatcttctcagtgtctaattgctatgatcagaaattcagagttatcccaggctgggtatttgcataccacaatgagaattgctacaactaatgttgcttgatggaagggcaggagctgaaattttacctgagccaccaattttctcaaaaccttggcctgagagagaattcaagttttacccagaagtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatagataaagatgtagccagtagaggccaaaggtactcaaatactttttatttaaccttcttactttttgtccttagggaaactgtagacactttgagactgtttattttatgcttcttttctaggaggtaaagcttttgggggaaggttttatgctttcagaattttcagttaacatttctgctttgtgatggtctcccaatcccatctccttcaatgacagctccaaaatatcaccagttttttatttttcttattcaaccctaagttttattggagaaccttattcctgcttcatggagaaaactggctaggcgtggtggctcatgcctgtaatcccagcactttgagaggccgaggtaggtggatcacctgaggttggaagttcaagactagcctgaccaacatggagaaaccccatctttactaaaaatacaaaaaaaaaaaaaaaatagccaagtgcgcgcgtggtggcacatgcctgtaatcccagctactcgggaggctgaggcaggagaatcacttgaacccaggaggcggaagttctggtgagccaagatcgcgccattgcactccagcctgggcaataagagcgaaactccatctcaaaagaaaaaaaaaaagaaaagaaaagaaaagaaaaagaaaattgatgatattttgtgtgtgtgtgtgtgtgtgtgtgtgtgtgtgtgtgtgtgtgttttagttctccagcccccttagaaagattctttcttccacaccaattctcatttccttttcttcaggtttagagatgacttctctcattcaagaccagttccttctctcctatctttcaggagatttctctataattcattctctctctccacactcaccccaccccactacatgatcttcaacctctccctctctcttctctacttgtcttcattctgtcagcttagaatcatctttcctgtgttcccacctagcaaatatcctttctttgacgccacatctctttagctcccatctttgtttatcttcgctttcttcttcttttttttttccttcgtatccaaatcatcattcattacacaactcattgaaatctgaattatctttcttttcatccaatgaatcatgcctaggtcaatgatttatttttccaccaaacttgctattcttcgagtatttaccatttctgcatgtgacaccactatctatctcagctagctgtctcagaaacgtcacatcttccacacccatcaagctctaattactttcttcctcaacagctctcaatttcctgtcctctctatttctgctaccactgcctatattctgagctttgttgtttcttactatgccactacatcagtctcccaactgatatctctctctctctccctccagccttttttttttttttttttgagatggagtcttgctctgtcgcccagggtggagtgcagtggtgcgatcttggctcactgcaacttctgcctccaggtgattctcctgcctcagcctcccaagtagctgggactacagccaccacgcccggctaatttttgtatttttagtagagacagggtttcgccacattggtcaggctggtctcaaactcctgacctcaggtgatccgcccgcctcagcctcccaacctccagctctcttctagttgtttatcctcctgtatcactagtgtacaccctcactcatattcactgtgtaaaatgcaaagctgacctgattaaaatctgtgttaccttcctatttcctgtggggtaatagtccaatcttctgtataaggctgtccacgatccatctcctgccatttttcctgctttttgttccaaccatcatttaccttgctgttcaccctccacaacacccacagttgctagtggttccctgtatttgatacgctgtttctcatgtttgcggtttgtgggagccttcccctttgccaatattggcatttgcctattttcttagttaactcgtggtcatctgttgaaaatcagctcgatatcatctctccaggaagccctccccgcatttctgcactcactttctccatccgttaccaaggttgaagcaccttcctttctgttggtataaagtaccatgcatatggccactatggccattgcactcatggtactgagttacctgtttttgtattttttttcctcaatgtgcctccatactcagtacatcatttttttctatagtactgggcaaggttcttgacacacatgagctgcttaattaagtttaatgtatttatgacaaatttagagcaggtttgaagaaattcaggcttttccccattaagtaatggtgcaccccattaagtaatggtgcactttgggagaaatgggctgaaaaagttttaacgatagcttttgcagcctatttgccccaattgtgtaaatactaatttaaaaccaaatgacttctagaaagtctgtagtcagtcttcaccattgggagataatgaggcaacatggattttgctgcctctctcttaaataacatgaatctactgtggagacttttaagcctatgatgatattttatatcaaaactgagataaataaaaaatgttcactgacaataatgactatagataaatgctgtcagttgtaaggaagtgtcaatcacagacagacgtcagtggatctgtgagggccacactgaatttttgcatgtgtaaactgtataaaataagattttaaagaatgtcataatcatattcagaaagtggaatgagtgtgcatctgaatggctgcccaatctataacgaatattctatctacagggcaataagcagaaaaggtgatgcagagcagccagccagatactatcatcctcatttctttaacatgtatttctagatccttttttgctcagaacattgttatggcattcctcagaacgcttttagtctctctctttctcttttatacttaaaattctaaaccagattctggtgtagagttctgagattatcactgtgccacagtgccattcaacattcctgggattacatttttctttacaaaaggtagcactttggtattcccctaggaccctcagattctccttttttcttttcattgctgcttaccagaaacaggtgctcctcaacctgtatttgtgcagtattttttgcaataggcaattatatgtacttttagtgataatagttgtttgtacattaacaatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaaaaaaaaaaaaagccttccatttccctcaggtagagtgaaactgacaactgagctgccctgcttctgccaaatatgaagatatctaagactctgcttctctgtttactgggcaaagtcctggagggagagtggggaggggaaaggaagaagtctgttgaacttggggcttagtttcactctggattatgtggcaaattgattttgataacaggcacctccccattcatacctatgttattcttaggattatgcagtaaaatagtttaatagtaaaaggatagaactttggtgttagaaagacctaatttctggtcctgactttgccactttactaatttgtggttttaagaagctacttaagtattccaagatgtagttataggtcacatggtttttgtgacacttaattggatagtgcttacttcaaggcctagcatgtagccagggctccatcaatattctctatgagagaaagaggaggaggaaaagactaaaaagtccgaaggatgatatgatgtagttgaaagaggatgcacttagacacttaaatcctgtattcgtttcttactgtctgtattgtgttgggtaaagcaacttgaactttcaaactcaccattttccaaatctattaaaaaatggataatcatgcttaatatagaacagttctgagaattaggtaagaaaatgtctatgtaagtgcctagtgccacatcttgccattagtaagaaccaagaaatgctatttgtggtgggatgccattgatgttgggtagagcttagctatgatttatgatactcccaagagactttttttttaatcgtgtgaagccatgtgttctattctgctcaacgttctcatcagactcatgattcctaattcttaaagcaaaaaatggggtctgagagtgtttcgtggcatgacagttgtggtcagaacccctcccatattcccttattctcaccaagtcaatgcaacttcgatcaggcatgcatttttctgcctgggggcttgctctttgctaatggatctgctttgtatcctgtgctatagaccagaagtgcagagaaattaatgtcctctttcctcagtgttcatcaaacaatggctggtgttgttttctactggctcctagaccttcctcagtgagctaaaattccattttccctagatagtagctggctcttgccccgtctgtaggtcacatccccgcatcacgttcctaataatctacctgcacttcactcttggtctgaaggtttgcttctgaggaaacccaaactaaggcatggggctactctagtaagccagcccagtgatgtttatggtgaattatcataagtagatctcgataccaggatttgtattatattgtacagaactggttataatagaactagctctagctggtctgaggcttaatatgtagattgaaataaacatgcctgagacctacagattatttttcttttttttttttattatactttaagttctagggtacatgtgcacaacgtgcagatttgatacataggtatacatgtgccatgttggtttgctgcacccatcaactcatcatttacattaggtatttctcttaatgctatccctcccccagccccccacccatgacaggccccagtgtgtgatgttccccggcctgtgtccaagtgaactcaatgttccattctcacctatgagtgagaacatgcagtgtttggttttctgtccttgtgacagtttgctgagaatgatggtttccagcttcatccatgttcctgcaaaggacatgaactcatccttttttatggctgcatagtattccatggtgtatatgtgccacattttcttaatccagtctatcattgatggacatttgggttggttccaagtctttgctattgtgagtagtaccaccataaacatacatgtgcatatgtctttatagtagcatgatttataatcctttgggtatatacccagttatgggattgctgggtccaatcataattctagttctagatccttgaggaattgccacactgtcttccacaatggttgaactaatttacactcccaccaacagtgtaaaagcattcctatttctccacatcctctccagcatcttttgtttcctgactttttaatgattgccattctaactggtgtgagatgctatctcattgtggttttgatttgcatttctctgatgactggtgatgatgagcatttttacatgtgtctattaattggctgcatagatgtcttcttttgagaagtgtctgttcatatctttgcccactttttggtggggttgtttgatttttcttgtgaatttgtttgagttctttgtagattctggatattaaccctttgtcagatgggtaggttgcaaaaattttctcccattctgtaggttgcttgttcactctgatagtagtttcttttgccatgcagaaactgtttggtttaattagatcccatttgcctattttggcttttgttgccattgctttttgtgttttagtcatgaagtccttgcccatgcctatgtactgaatggtattgcctagattttcttctagggtttttatggttttggatctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggttgtagatgtgtagtgttatttctgaggcctctgttctgtttcattggtctgtatatctgttttggtaacagtaccatgctgttttggttactatagccttgtactatagtttgaagtcaggtagcatgatgcttccagctttgttctttttgcttaggattgacttggcaatgcgggctcttttttggttccatatgaactttaaagtagtttttttccaattctgtgaagaaagggtcattggtagcttaatggggatggcattgaatctataaattactttgggcagtatggccattttcacgatattgattcttcctatccatgagcatggaatgtacttccatttgtttgtatcctcttttatttcattgagcagtggtttgtagttctccttgaagaggtacttcacatcccttgtaagttggattcctaggtactttattctctttgtagcaattgtgaatgggagttcactcatgatttggctctcagtttgtctgttaatggtgtataggaatgcttgtgatttttgcacattgattttgtatcctgagactttgctgaagttgcttatcagcttaaggagattttgggctgagacgatggggttttctaaatatgcaatcatgtcatctgcaaatggagacaatttgacttcctcattgtgtaattgaatacagtttatttctttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcataaatagctcttattattttgagataagttccatcaatacctagtttattgagagtttttagcatgaaaggctgttgaattttgtggaaggccttttctgcatctattgagataatcatgtggtttttattgttggtgctgtttatgtgatggattacgtttattgatttgtgtatcttgaaccagtcttgcatcccagggatgaagctgacttgatcatggtggataagctttttgatgtgctgctggattcagttcgaaagtattttattgaggatttttgcattgatgttcatcagggatattggtctgaaattctgtttttttgttgtgtctctgccaggctttggtatcacgattatgttggcctcataaaatgagttagggagggttccctctttttctattgattggaatagttttagaaggaatgctagcagctcctctttgtacctctggtagaatttggcagtgaatccatctggtcctggactttttttggttggtaggttattaattattgcctcaatttcagagcctgttattggtctattcagagattcaccttcttcctggtttagtcttgggagggtatatgtgtccaggaatttatccatttcttctagattttctagttcatttgcatagaggtgtttatagtattctctgatggtagtttgtatttctgtgggatcaatggtgatatccccttttttttattgcatctatttgattcttctctcttttcttctttattagtcttgctagtgatctatcaattttgttgatcttttcaaaaaaccagcccctggattcattaattttttgaagggttttttgtgtctctttctctttcagttcttccctgatcttacttatctcttgccttctgctaacttttgaatttgtttgctcttgtttctgtcgttcttttaattgtaatgttagggtgtcgattatagatccttcctgctttctcttgtgggcatttagtgtaaatttccctgtacacactgttttaaatgtgtcccagagattctggtatgttgtgtctttgttatcattggtttcaaagaacatctttatttctgccttcattttgttatttacccagtagtcattcaggagcaagttgttcagtttccatgtagttgagtggttttgagtgagtttcttaatcctgagttctaatttgattgcactgtggtctcagagacagtttgttgtgatttctgttcttttacatttgctgaggagtgctttactcccaattatgtggtcaattttggaataagcgcgatgtggtgctgagaagaatgtatattctgttgatgtggggtggagagttctgtagatgtctattagttctgcttgttgcagagctgagttcaagtcctggatatccttgttaatcttctgtcttattgatttgtctaatattggcagtggggttttaaagtctcccattattattgtgtgggagtctaagtctctttgtaggtctcgaaggacttgccttatgaatctgggtgctcctgcattgggtgcatatatatttaggatagttagctcttcttgttgaattgatccctttaccattatataatggccttctttttctcttttgatctttgttggtttaaagtctgttttatcagagactaggattgcaacccctgctttttttttttttttttgctttccatttgcttggtagatcttcctccattcctctattttgagcctatatgcatctttgcacatgagatgggtctcctgaatacagcacactgatggatcttgactctttatccaatttgccagtctgtgtcttttaattgggggcatttagcccatttacatttaagggtaatattgttatgtgtgaatttgattctgtcattatgatattcactggttattttgcccattaattgatgcagtttcttcataccatcaatggtctttacaatttggcatgtttttgcagtggctggtaccagttgtctctttccatgtttagtgcttccttcaggagctcttgtaagacaggtctggtggtgacaaaatctctcagtgtttggttgtctgtaaaggattttatttctccttcacttatgaagcttagtttggctggatatgaaattctgggttgaaaattcttttattttagaatgttgaatattggcctccactctcttctggcttgtaatgtttctgctgagagatctgctgttactctcatgggcttccctttgtgggtaactcggcttttctctctggctacccttaacacttttcccttcatttcaaccttggtgaatctgacaattatgtgtctggggttgctcttcttgaggagtatctttgtgatgttgtctatatttcctgaatttgaatgttggcctgccttgctaggttggggaagttctggataatatcctgaagagtgttttccaacatggttccattctccccatcactttcagggaaaccaatcagacgtagatttggtcttttcacatactcccatatttctttgaggctttgttcatttctttttactcttttttccctaaccttgtcttcttgctttatttcattaatttgatcttcaatcactgataccctttcttccacttgattgaatcagctattgaaacttgtgtatgcatcatgaagttctcgtgccatgattttcagctccatcaggtcatttaaggtcttctctcactgtttgttctagttagccattcatgtaatattttttcaaggttcttagcttccttgcgatgggttctaacatcctcctttagcttggagacgtttgttattaccgaccttctgaagcctacttctgtcaactcgtcaaagtcattctccatccagctttgttccgttgttggtgaggagctgtgatcctttggaggagaagaggcactctgatttttagaattttcagctttcctgctctggtttctccccacctttgtgctttcatcccacctttggtctttgatgttggtgacctacagatggggttttggtgtagatgacctttctgttgatgttgatgctattcttttctgtttgttagttttccttctaacagtctggtccctcagctgcaggtctattggagtttgctggaggtccactcaagaccatgtttgcctgggtatcaccagcagaggctgcagaacagcaaatattgcagaacagcaaatattgcagaacagcaaatactgcaggaaagcaaatattgctgcctgattcttcctctggaagcttcgttccagaggggcagctgcctatatgaggtgtctgtcatcccctactgggaggtgtctcccagttaggctacacgggggtcagggaccaacttgaggaggcagtctgtccattctcagagcccaaacactgtgctgagagaaccactgctctcttcagagctgtcagacagggacgtttaagtctgcacaagttgtctgctgccttttcttcagctgtgccctgcccatagctgatgtggagtgtagaggtggagtctagaggcagtaggccttcttgagctgtggtgggctctgcccagtttgagcttccaggccactttgtttacctactcaagcctcagcaatggcagatgcccctcccccagccaggctgccaccttgcagttcaatctcagactgttgcgctagcagtgagcaaggctctgtgggtgtgtgacccatcgagccaggcacaggagagaatctccttgtctgccagttgctaagaccttgggaaaagtgcagtatttgggcgggagtgtcccgttttttccaggtagtctgtcatggcttcccttggctaggaaagggaaatcccctgaccccttgcacttcctgggtgaggcgatgccccaccctacttcagcttgccctccatgggctacacccactgtctaaccagtcccagtaagatgaaccaggtacctcagttggaaatgcagaaatcacccatcttctgcatcgatcacactgggagctgcagactggagctgttactatttggccatcttggaatacccactccagatttcttttcttaaaataatacctttctaaatacctgttggagtgcttgagttggtaggggctatgggaatgtcatctgactgattttgtcagaggactttgtggatttgagacagggtgggtaggagaggatcatcacattgattccagaactaaacttagggcttgaggtcactttaggtggggtagaagtggggatatctggcatactatgagatttagagggccactgtagcctcataggtactcagactttatagtgttggtttaattagggattttcttaagctggctgccctgattcaaggtgatggttatctgagcaccaggtaaggcctgggaagggtagaggcaatatggctagatgtccatttcctataatctctaaatttgtatgaattgatgcattcatgatctgagatcataaatgaagtccataaagtccataaacctcctgatattttatgtaaaacttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagccttgggatccagaactcacccttaaataagcatagcatctctcttggtgggggtctgtggaggtacagggaggttggagagagttggcattacccaatttagtgaggttaagataaacactgcagagtaatccatggctgacctcagtgatgagttatccattttgcaatctggccttttattacattgctgttgactttgttgttgttgttattgttacatgtttgtttttctttggatatcaatgcttttatgggaattatttctcatttcgttaatcctagcctagtttccttcaaaagggtcttgagtgcaggtagcctcttcagggtagagtaaaacaacaaaaaagtcaaagccggaatcaagggtgtgttttctatcatacagaatattatgatggaccactgaggctcagtgccactagggactctcttgggaggtgcatagaatgaatattaaaactctctgcctgaaagatggaataaggcagaatgtatttactgttcccatttccccttggccaaggattacttcatggggcattaactgtcttacatttccaggtttactcagatgccctgcaggttcccacaggcttcctgcatgctgatagcagaggagccctggggcacaccatgagagatacatgatacagctcaggcaaatgctatcaagttataccaaaggcacctctttgcagcagctggcatgcaaaagtgaacagagaggatatgagggcacaagaggtgtctcatacaccttctccattctagcatctctcctcactgagaccatggtaatcttaacttgtaggcatgcagtgttaataaatgaagccaaagtgctggatttgatccctatgtaggtcacttagctgcccacagtgaaaagtagcaccatggacatcaaagtgaacaaacccctgcctgagtacttatttccatggatcaaaaggatggggaaatgctgatggagagttgaactttataatcgggaaaagtccattcaaatgggctattttattcaattcccaaatagccctagactttatataacttacatggtggaattcatgcttttactaacaagtaagttaaggctcatagaggctgcgtgacttgaccagggtcccatagttaatagactgaaatgtattccttcttacttcaaacttgttcacatcatccagctctctggcaacacattactggaaaagaaaaatagttcagagaaggatgtgctcatgaggactgcatagagttgcaatcttcttgggagggtacacatgcatgacctgccaaatctgaaatattaggaacttttgcttgcaacttgttccatctacagcatgggtagaggtggcaacagagaggtgactggggagaggtttgcccaagagacagcagggagattctgggaataaacaggagttgggttctcaatttggcaactaagcattcttttgttattgcactttctcaggctgcagcagagcctgattagctttaaaattcatttccattggtttcttctttcatgatagttttagatgttgttttattggcattcctatagatgtaatttaaccttggtagtactgatgaactggttgttctcttgtaaattttagaaggaaggtggacagtctgggagaaccagaactgacaggagcaatagggtgcattgctaactggcaccctgtgctctgaggtcaaaaggaaacataggaaggtggtttctgagggcaagacctaggctcctctctcaattctcttttgatttcaaattttgtttcttaatttactttaaacacacacacaaacaactttacataaatgtgtacatatgatttcagtacattttcctaagtgtattcttttctttccatttttgtttgatgtctcccctcttctcctttttgtccatgttggtcccctaactctactccaagatagttcatattaataacctagtataaatcctggcacatttttctctatacacatataatttatacatatagaaatgtatacaagtttttcaggtcattgttttataaaatgggatattatatacttattttgcatcttgattttctttttagaagaacactattgtgcatcatagaataaatacaaaaaagtttaaaacatatttaggtactttaaataataatgaagcaaacatttgtagtatgtctatctacccactgcattaaagaaatagggaattaccagtgccttagaacctgctgtgtgccactttgcaatctctttttcctctttccctcaggaactctactttctggaatcagtcctgtgtttctctttctatattttgcttctgttgctcaacattactttataaaaattttttcatatcaaaaggcagtgctctaattcactctttttaatgggtgcataatattccagtctgatgatatgttatatatgtggtattctccttcctgtaaattataattttatttccatcttacttttttctaccatgcacaatgttgcaataaatatcattgtgtatttgcactggtgcttttatatctggtgcagtccaggaatggggttgataaatagaagaggatatgtattttaaatatgaacaaatactgtcatatggcttttcaaaacattgtaacacttcacatactcaagcaatgtatgagcacacccttttcacacatccctgatagtgatacgaattattgcttttttaaattgtgccagctgagaagtgtaaagtgatatttcattgttattttaatttgcatttctcggactgttagtgaatctgagcatttttgcatttgtttgtaggccatttagctgagcacttctgtaaatgggctattcatgacttcttgtttctacaatggagatatttgtctttttcttgtctttccatagtaatatttgtttaccttgtttagggtatattttgccatcaaatatgttactttttaatgtagttagatgtctgtttttaactttcacatcttctaatttccagtcttcgtagagaatgttttccccgtccccacctttaaaaagtgtgtttagtttttaagattctttttaaatctttgttttcattttttatatttaaatcttaatccatttagaaatttatttttgtgtttatagatgctagaggtccatgtttactttgttcctgatgataatgataataacaatagctaacacttactgctgctatgtggtaagcattgttatataggcactttccacatattgcatcgctgacttggccttgtccctcacaactctgagacataggttttcttaccatatccattttacacttgaggaaaatgaggcacaaaaaaattgagtaattagcccaaaggtcacagaggaggtcaagtggtgaatgtgggatttgaactctgggaatctggcactgaaatccactcttattatagttcctcttatttgttaggccaggactatttatgaaaaaagccactcttttcccactgaattacattacttttcttgtcatttattaaattctcacatataccagagtttatttctcgattgtctgtctgctccctgatcttttcatctattcctagcattttttgttgagttgatgatcatggtcgtataatgtctgatatctatgaagtccagtcttctgtcattgctctttttttttcatttatttttttttgagacggagtctctctctgtcgcccagcctggatgcagtggcgagatctcagctcactgcaagctccccgtcctgggttcatgccattctcctgcctcagcctcccaagcagctgggattacaggcgcccgctaccacattttttttgtatttttagtagagatgggtttttaccattttagccaggatggtctctatctcctgacctcgtgatccaccctcctcggcctcccaatttccaggcattcatacttttatgtataatttatgtttattttattcaattaaagtagccgatgggatcctaattgaagttgtattaaatcaatatgttaattttgggacaattgccatgttcatactaattactccataaatttaaaatatagtatgtttcctcttcattcagaaattaatttatatcttttatatatttatattttctttgtgttgtcttttaaatttttgggggagatgtatttataaatattttaaagcttttgctgatataaatagaaatatttttctcatttctattccttagtgattgttactagagttgagaaaaggtactgattttgtatattttatatataaatcagtaggaagagcactgtcaatctaatatttttaattaattaaacaagaaaaatacattcatgtcattaagggctgaaacagcttttgataaacttcagcaggcattattaatacagttcaggtaaaattgaaataaaagatgattgcttagatatataaagattatttactaaaaacagcaacagatttaacaaacatggagatcattttagttaaaattagaatgcatttagggatgtcccttgttatctatattaaacattgcatttgctatagcctccaaggccataaaacagaaaagtaaaatagttggtgtaaatatcagaagaggtaaaactatctctttttgctgatactataattccttatcaagaaatttaaacaactctagttaaaaacttacagaatgaataagatactttgataagctatctggatataagtatataatatcaatcacttctttattctatcaataattaaccatttttagttctcaaggttcaaatttcagagaaggtggctttgagctataggttggatcatttcccatgacttggacagggagataaaagcttcttaggacggccccactagactctaccaagtggaacaaaggtgattgctcaaatttgagctgaaaggggaaatggatgatagacagaagttttttaaaaaataaactccacatactgtatgtaactgcacttcagaagtcaggtgcctagcttttaagaggataaatctaaattctttgcctgcttcttctagaatccttcccaaacccttttccgttgccccctccctttttacctgttctacactgcatcccaactggttgttacattgtcccctgcacacgttttgcacattcctctgttgtttgcccatccattcccctcactagacgtattctattcctttttctttcatgtaattctgattcgccctgtagggctctctgcacgttcccatcaaatgcttgttccattacccaagaccaggtcccttctcccaaaccacaggggctctaggagcccactctaccaaagacctgaagaacctccagctgtcacagtctcttcactcctaggactgaaggacctgttctcttctccgcatctgttcctgcatccctgtgacatctgccccaacgaaatcagaagaggagaagggaccaggactctcacttcccagactatacattgttcagcttcctctttccccctttctgacatggaaatagcgagcgaagatttgagggccagttttttcatgttgttgttttgggatgttttttggtgtgctgtcatagattttattttttcatttagagaagccaggtccaacctaaacagtttcatactcttaccaagaggatgctttgtccttcactgtttcaagtttgtacaggattcaggaccatgttttgcacctagtaaatgagtcttcgtttatccaaactattttgagttctcacctttatgcctttgctgttgctatgtcatttctcctgaaggcccttctccttctctttgttcacttgattactcttagtttttacatttcagctcaggtgtcaactgctccaagaagcctttctcgagctcatgctccccttcaccaaactgccacaacaacctgtgtgaatcttgatcaccaagcttacagtgctgtttgagataattatctgctcaagtttctggtgttcccattagactgtcagtgcctcatcgatgtgctcagcctctagctgtgaatggtgcacaggtgaccccagtggatattttttgaataaaaaaataaatgtatggatgaactgagcaatgttttgttaccatggatgttggtcatatcatttcatgatttgctatctaattttgccatttctcctctaattccattaccctcccagctcttgtttctctacgtgagcatgttgtgtgaatgctgagtgaacttttagtttactatgcattcatagtgcattcattccagtattcatttcttccttgggtcctggcctactccttccttttctctcatctattcattctaatctcatttgaacatcaagctcctcccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgataattcagaagcagaactttgtcttattactgacttccagaagaaatttcacaactctcataaagtttgtgatttttgtagactatactgaacatttagtgactcccagggaggatcattttaatcagcatacaatagtttgctcttcctcttcccttccattttcttctttccctttctccccccttctctagttttttaatctcacctcctctccctgcccttttctatcctcctcccctctcatttcccttcctttatttcttctctcatttctactctttccccctttctccttccttctttcctgccctcctcccctccctcctcacctcctcccctttctccttttcccatccctccttccctccttccacttctctctcctctttcatctccctttctatcctccctcttctctcccttccccactctacttccccccattcctccctggagttctccctttttacttttcttcaagtgggcttatcaaagtattttttttaaataaaataaaggcaagtctttctgtaagaaaaaaagtcagaaaaacattttcttctcattataggaccaaaagtgcccttagagatcaagtagcccagtgatccccagactttgcttgttggtcgcgataccctgggcagcatttgaaagccaggccctgcctccagtggtggttctgaatcaaaagatcagtgtagaggcttggagtggcatttgtgtggggtgtgccagaatatatttattttaattcaagaagatttggatttcagtcctaagtctgtcacttgctaatggaaccatcttggctgtgtgctattaaaacttccagagcctcagtaacatttgtaagaatgtggaaaataatatcttcctcaaataacaagcagtgatcagcagattggctggcacatagtaggtgttaaaaattgtttcttttcttccttccttttgagtatggtacagaatcctggttatctctctcaacacacaggatggtgataaaggaaagcctgagtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaaccccatttattgtgaattcactttcccaggactattttaattaatcatcataacaaccttatgaagtaaatgctatgattatctttaaccacattgacttggtaaaatgtctgtaggcagagcttttttatttttttgaattttggctactatttgcatgtctgtatcatttacgccgtcctttgtctgtgtttcttagatcccaaataagtactgaggggtcctatattcatttcaaccatactgtattgagtacctaatataaaaaatccagcctctagtttgaggagctgaaagaatgaaccctatgcagtcctgattgtctgggcttattttcacttgctctgtgaagcacctgagcccttgttggtgaaccctgctacagtccccactgagtttaagacccactcttttcaagggtccccatgttaggtttgcctccacaccttagcttccaaagctttgttcccccctgccaatggggcactctagccccatccacccatcccctctcagagttgtagaaaaggcttctatcagcaagaatccagagaggttattcatacatgggacacttgatagtggttcttattctttgaggaggaggaatacttctgatttaatggtaacgaagttctaattttggtaagtccggggatctgaggctagagctgctttgtcacaagtcttgtttgcatatgctgtgtatttctacccataccctcatccaacttatctaaatcttgctcctttttttccattcttgctgatttaattttatccctcaactcatggttccaaataatcccctgtgttagttgtgcctacagcaacttgtttaactctctctaccaggcaataaggtggaggggcaggggaaggataaatgcagcctacttgtgatttatcacagttggaaagaaaagggaaaagacatgcataacactttttaaaaaagaaccagagaggcagagagagaagagtgtgtggagggagatgaagggtgcactctgatgggaacagatggcccaaaaggtaagtgggtggcagagagtaaaaataaccagggagtgaccaagccttcattttctttgaaacactcacactttagggatatattgaaactgctaattttgttggcactttgacacctcctcctaattaatgagaaatttattaggaggatgactgaggtgagcaagctgcttacaaagagagaagggagagaatacattgaacctattcagcttggcggtcacgaccaagcgaggtgccattggatatgtggttacttgtgggtgagctcaagtagaagcctcgggctgggctcctctcctggggtggaacccttctgctgggctcctttcctcctggctccctgtactcactgctgctctctggtttaccagcatagaggcacaaccccaaaacaggcttcgtggggaccaaattggcttttggatctcaagtgtgtctctgagtcactccagtgaacacgttataggtcactctgtgcaggttagtggcccgaaaatctgcccttcaaaggaaaagaaaagtgaaattctcatgacttttacactttttgtcaaatcttctgcatagagaccttctgagttggctctacctagtctgtgattccaaatctcaagcaccacctgcaattgtccatatttttcacccacaggatgctcatgttaccaggaacttaaaagagtaaacgtggttgctgacattttagcgttcgtgggccagttttctgagatcaacactaggcaaggtactggggagtgtcttctaacacttttcagactttgaacagctaactccattttctgggagagcagggttacttgacaggtatctaaatcctctgtcctagccatccaccaagccacccatttgcccttccaaatcccttatgcagttcattatctgtgcaacatagaacagtcgagagcatgggctctggaggcccattgggagcttattcactcctctgctctgccattcatcagcttgagttgtcttaggcaagtcacataccatcctctgtgtctctatttctccctctgtaaaatgagatcactaatggcattcactaacggatggttgtgagagttaatgaggtaacagttataaagaggttagtactgtgcttggtataaactaagcacaaaataaatagcactatgacatttaacactataacatttaactttcaaaatgatttcatatgcaattttgtggcagtgtcttcatacattgggtagtacagagttttaaagattatcctttaataaatggaaaaattgagtcatgtaatggattagagactttcccaaggtttacaactacagaggaatagaattggctctagagctaagtcttctcattctagtttaattgtttgtttatttgtttctatgcaaacatgttcatactcttccttagcatgtttcatcctatctctactagtgcaacaagatgctgagaagagggaagaatgccacaaaactgcatacaccaaagatgtgtggctcaaaggatacaacttttgacttgaacagtcaccaggccttgtgatcttgaacaaatcattctgcctgtctaaacattaattaattcctcaacttttaaatggaatatgatgactatttccctttatatgtgtatcttagatgtaggcatggagctaaaatagaaactcaaaatgaagtaacagtaagggctggcagtggaatattattgatcccagaggaaaataaaaattttatttccaacgttgtgccaagatggtggcaagggtggggaaaccatgtgtcctagaagaagaaaacagaagaggttaagttacctctttattcttttgtttttcagattcaaaggttgtctttttaacaaaatgaataatgcaggtggtgattatggaaagatgttaaattttgatgatgttgaaatgtgagattggtatcctgtgtgtgaggagctcttgtctcctttttcaaaggcaaggttcctatgtgtgcactttcacagaccagccctgcccctgttgcctggaatctcccttctagcacaggctgctgctgaagaggtggttcagaccattttccaaggcaaatccaaagaaaataatggtttccattggttctccttattcttcagccttcccagcttcccccacccctactccagtcttcatgacatcactaattcatacatctattatgcaactcatgccaagaggctggttaaattggaaattgctctttgttaaataatactggtatagatggcatttccattttaatccaaagctcttgagattccaaaatccttcaaaactcaactaaatttcaaaaggtgtaaatcaagcactgcattttactgactctaaaggaaacgtttatgtgagagtagacctccctggagcttcttaaactagccaatgttaatcttggtgctgagacatattgatggtatgtcatatgtaataggttaccaaataataatgcatatactaaaattatgctaaagatttactaaaaatttaaattaaggcagatcaggcttatggctaaaataacatcatttccatgcacctgcattctgacatgctctctggagattctttgctatgggagtgtgccttgtgtataaatagcatttatgatgttggttgcactagaaaaaggaaagttatcaactttaagctccactgaattaacaaatacctgatctccatttttgtagaccatcaagaaatagcattgtgatcattgggcttctccctagcagttgatggtaaaaaaaaaatacatctaggagacctctcctctcctctcttctcctctcctctcccctcttctcctctcctctcccctccccctcccccttcccctcctcctcccctgcctgtcccctccttctcccctccccctcccctcccctccctcccttcccttctcccttcccttctctcttctcttccctctctcctcccctccccttccctctcctcccctctccgctccctcttctcttttctgagaccgggacttgctctgccacccaggctgcagtgcatgatcatggctgaatgtagccttaacttcccaggctcaagaaatcttcccacctcagcttcctgagtagctaggaccacaggtgaaaatgatcacacctggctatatttttttctatttttttttttttgtagagatgcagtctccccatgttgctcaggctggtctcgaactcctggctcaagcaatcttcctgccttggcctctcaaagtactgggatcacaggttcaagccactgtgcctggctgagatctctatctttaatattcctcttccctcctgcttaattgaatgaggaaggggcagtgtcatacaatggaaggagcatagtaactctaacattaataggttgtgtggccttgaacaattcactcaactgctctgaactttagtgtgtcatccataaaatggagctaacagtgactagtttgttttgagaatgagaaccaagatgcgtaaagttcctgacacaaagccaggtgcctagtggcctttagttcttatgacagctgcaggactacctttgtcactgtgcttttacgtctcctccagtgcctggtaagaagagtttatgtatatttcacctgtgtgagtacaaggcccaacttctaactgttaataagagacaactttgcctccctcacagctggtacttaaagcgtcaaagaatatctacactccagatacttgttaagataattcagtcagaatcgactgcaatctagcacctgccagaggcttgctgaaggcatctgttacttatttattgagcacatgattatataactcttgtttactgtacacccagcactgttctaggagtcttaagaatattaacttatttaattctcacaacaaacctgtgatataggtactatcatccccattttacagttgagagaactgaggcacagagagggtaagtaacttccccaagatgacagagctagtaagtggtagagcagcatttgaacctagatggtttggctccagagtttgggaccttcacaactatactatgtaagaaagactggctaatcgttatgttcaccagccattcttccagattcatccagttctttctctgagcttagtgaaattatcagaaaacaagagacccaaacatgtgacttcagcactcccttcccccttccaacagcttcatgaccatccttcagttcctgagtcacctttctagatggatattctgtgtcttcgacaaactcctggtaggaattgtcttccatgttatccaacagttctaacatgaaaacccatgtattaaagtatctaaacaaagtgtgtttctgcataggacctttccagctttatttgctatgaaatgaaaatgatgaagtctgttagttccctttctatgaatattttcattgctattactctggctaacttctgtgctcaggtgtagtctccagttctgcctagatagttgctgatatttactttctctacttcctttagggggcatcttttctgtttttatccctgatggttctgttttcttattgattaatctcatataatgcctctgaatctgttggatgcagggaaagtataaaccataatccaataagcagcttatgatgattttcttaccatgtaaaatgtttcaaggtgtgtggactaaagtagaaggagatgaaaaaaataatgataaattatatcatctattatggatagctaccatttgctcattgcttactttgtactggcactgtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatatggtctagctctgtgtccctacccaaatctcaccttgaattgtaataatccccatgtatcaagggtgagactaggtggagacaattaaaaaatgggattggtttctgccattctgttctcgtgatagtgagtgagttctcacaagatccgatggtataagggggtataagaggctaccccttttgcttggcactcattctctatcctactgccccgtgaagagatgccttctgccatgattgtaagtttcctgaggtctcaccagccatgcagaactgtgagccagttgaaccacttttctttataaattacccagtctcagttacttcctcatagcagcatgagaacagactcatgctggtaccacagagagtagagttctgctataaagatacccaaaaatgtgaaagtgactttggaactaggtaacaggcagaggttggaacatgttggagagctcagaagaaagaagacaggaagatgtgggaaagtttggaacttcctagagtcttgttgaatggctttgaccagaatgctaatagtgatataaacaatgaagtcctcagatggggatgaggaacttggtgggaactggaataaaagtaattcttgctatactttagcaaacagactaaatttgcatttcacccctgccctagacatctatggaactttgaacttgagagagatgatttaaggtatctggtggaagaaatttctaagcagcaaatcattcaagaggtgacttgggtgttcttaaaagcattcagttatatgtattcacaaagatatggtttggaattggaacttatatttaaaaggtaagcagagcataaaagtttgggaaatttgcagcctgacgatgcgatagaaaagaaaaacccattttctgaggaaaagttcaagtcagctgaagaaatttgcataagtaatgaggagccaaatgttaatcaccaagacagtggggaaaacgtatccaagatattcagagatcttcatggcagtccctcccattacaggactagaggccaaggaggaaaaaatggtttcatggattgggcccagggccttgctgctttgtgcagtctcagaacttggtgctctgcatcccagctgtggctaaaaggggccaatgtagagctcaggccattgcttcagagggtacaagccccaagccttggcagcttacatgtggtgttgggcctgtgggtgcacagaagtcaagaatttaggtttggtaacctccacctagattttagcagatgtatgggaatgcctggatatccaggcagaagtttgctgcaggggcgaagcccctatggcgaacctctgctagggcagtgcagaagggaaatgtggggtctgagctcccacacagagtccccactggggcactgcctagtgaagctgtgagtagaggactagcatcctccagacttcagaatggtagattctctaataggttacaccatacacttggaaaagctgcagggactcaatgccagccaatgaaagcagccgaaagaggggctgtatcctgcaaagccacaggggtggagctgcccaaggctatgtgagcccacctcttgcatcagcatgccctggatgttagacacagagtcaaaggagataattttggagctttaagatttaactgccccgctggattttggacttgcatgggacctgtagccccttcgttttggccagtttctcccatgtggaataggtgtattcacccaatgcctgtaaccccattgtatctaagaagtaactaacatgctttttattttacaggctcataggtggaagggatttgccttgtgtcagatgaaactttggacttcaaattttgagttaatgctggaatgagttaagactttggaggactgtgggaagggcatgactgttttttgaaatgtgaggattaagcataaaataatggcaaaccgcacaagaattattacaattcaaggtgagatttgggaggagccagggacagaatgatatggtttgcctctggggccccacccaaatctcaccttgaattataataattcccacatgtcaagggtgggaccaggtggagacaattgaatcatgagggtggtttctgccatgctgttttcatgatagtgagtgagttctcatgatatctgatggttttataaggggcttccctgtttgcttggcactcattctgtcccctgccgccctgtgaggaggtgacttttgccatgattgtaagtttcctgaggccttctcagccatgtggaactgtgagtcaattaaacctcttttctttgtacatttataaattacctagtctcaggtatttcctcatagtagcgcaagcacagactaatacaatggccaagaagtgatcataggatggtaatataataaacacatggaggggaaagtgagtgtagttgcaggttttcaggagaaaatctgaaaggggtgaccaaaaatgagtacctgaatgatgcagctttttgaaaaagtctatttgtaggtcattaacaaattgagattcaggaaatcattgtatggtttaaataggataaaatttttcactagaatgcttgatctctggggattcccagaagcccattcatgaaagtggttcattcatgcaacaaatattttaacaaatgccaagtatgttgtagaattattttaggtgctaggaaaacagcagtggataaaacaaaaattccttagagtttatattctaatggcgagtcataagtaatctacaaaataaataaatatacagtattctagatgatggtaagtgttttaaaggaaaaatgaaacaacaaatagtgatagtacaagcgggggtggtggtgataatttcaagtttaggtagggtaaagaagaagacatggatagacaggaagcccagatatagcatagtattccagggaccaaagcaagatgttcaggaaactagaggcctcaaattctcctactgcaatctgactttgtaccccaattaacagtgacagcatactgctttaaaataggaaataaagtggaaggaaagcaaatgcttgatagttgacctgacattcactgttgcaagattgggaacgtacaataaatgtcactgatggagaaatattcatgaagtaaaaatgtcagttttcaatttggcatgaggatggtttgacatgtattagtcatgcacagaatattatcataattaatgcattaataatacagctgtcctttttctcccaatcataagttaaaagggaggaaatagaggcaagtgaaagagcagctctcatcctgatcagaccttttctcttggcatttgtctcttcctctgcccagccatttctgtggcattggcttctgatcagtatcagtcttgatttatccatctcagttcttccttcacctttcatgaacaacaccagtggttttgtctgctgagggctttttccttaattttcagccatactttaaaaaatattttaaaagagagagatatatatagtaaaaatgagacataagcaaaatcaagaatataaaaatctcccataagctcactacccagagaaaactactattactattttggtgtttgtactgatctcggatagctggcgctgggatgactcaggggatttgattcttctccactgtttctcattctccagcaggctggccctagcctattctcatgtcattggcagaggcacgggcaagcttattctcacacctgctttttaagtctctatttgtgtcacattcactaacatcacaaagcaaatcatgtgattaagcccagtgtcaaggggcggaacattctgtcctacccatagttggaaggtactgcagggttatgtggcaaagggaagggtgaaaacttggggcaaaatttgcgacttcctatactgggtcaaaagacacccttgtttcaaggcttatgatagatgtttccaaattgctttctagaagggctgaaccaaccccactaatggtataagacttcctggctttccagttctctttagtcttgctgattctgggaatgatttatgaccttctgtctgggctgttttgatttgtatctccacctgtcttttaaggctgcacagtttttctttgtggtaattctttacttgcagaatacccccaaagctccctaagactctggtctacttaccttcttcatcctgatttcttctgcctgctttatctaacacttgtgctgaccaactcccagctatctgaatattcagtaatccatgtaggcctactccccaagtgttctaagttggtaggagttactacacatcttttaactttgctgcctacaccagcagtaatgtaattgttggtcctcattattcccagaatattggaatttttagggtcagaaaagagctcagaatccaatctcatttttatacaatattattccaaagatgtatgggtatttgtgtagatgaagataagggtatagatagaaatttgcatagaaaaaaggttgaaaggcattgccattgttaatatgctagtatacatctgtatatgggaattataggtgaattttttttttgcgatggagttttgctcttgttgcccaggttggagtgcaatggcacgatccctgctcactacaaccgccacctcccaggttcaagcgatcctcctgcctcagcctcccaaatagctgggattacaggcttgtagtaccacgcccagctaattttgtatttttagtagagatggggtttctccatgttggtcaggctggtctcgaactcctgacctcaggtgatccacccgcctcggcctcccataggtgaattttaaaaaatctttaatgttgcgtacagaaactgagggtcacagaagttaaataactcacctcatatcctaaagattaataatagtgaaactgactaatgcccagttctgctgattcctggtttaatgctctcttgagataataccacagtatgatctctgaggcctagctgtcttttgtttgattgtttgtatccaagctgtattggcagtttcttttggttttataagagtgctctgctgattgtgggttcacagggaaataaagaatgttttttaaatgattgagtcatctaagtcagctatgtaaatgtatatatatatatacacacatatatgtaatatctgtatgcataaattaccatgacttcaaaatttgacaaatggttcaggtaaatagtggattttatcttttaaatcacattaaggctcccaagtggatgcatcctgagttctggacacataatttatcataggcatcacatggattttatgtaattatattaattatttagtacatacaaaggtaagctctgcagaattagaatagaatcggataagtttttagggagatctaaattggtaagattgatcaaatttcttgctatgagtaattgaaggtgggtcactgtgatggagtgttcttcactggagctaagcttcactagagctattcggagtaattggggactggttaggagaccaatgcatcaacatctgtctataggaagtatggattcatctgctttgaaatgagtctttagtttgtttcctgcttgttctttatttctttttcacctgaatgctctttcaagaatattcaaaaacacaaaaacaaaaacttttcccctggagagtggggattagctcaagaatcaccatgatgatgagaagcagaaaacctggtttggagagtcctggacctggagaacaccaaaaagatgttagcatcttgagtatattgttctgatctaaagtcagatgttaaattttttactcacttagggctgtctgtgagactttgcggatcacagagagaatagacactgagaaatgaacgtgaactagtgggtacaaaggaaagggcacccgaggctgcttcatcaagctagaggagtgggaatctcagcccctgagaatgagcatctacaggctcttttttcctagtgcttctgtggtgtttgtttttcattgtgccacttggtttgcagaaaagaaaaaagaaaaaaaaaaaggctgccctggaagctgaggttttacaagtgctgagagaactgtcaacctattatagaattcagacagagactttcagctagagagggtttaggtattctgtgcctggctggactctagggactcacgcttgatcatactaggattcaagaacaacgcagttgtcactgttagcccatgatcccacacgtacccagacacattctctcacggcaagtacatctgcacctggatgccttctactagtatgacatacttaaaagtatcttggatatgccttaaagatcattgttggctgcttcttgatggcaaagtgctcagttagagccagtttaaacacatgtcaccagaactgaataaatagattttgataaaactgattcagtgaatatctcccttagggcgaagctcagccttctccacttcactggtgctatgaaaatcactagtcctcatttccaagctgtgtctgaattcagatttaactgctaaccattgtttaagaccgcagtgagatccacagggtagtctcaaggtgtgattaagacacttgggagtggtggtggttaaaaaaaaaaaaaaaatagagccaaagtgtaaggaggcaagctggaggcacgtggttatatgaggagaaaaattgcagtgaggccttctcatcaccctcttcagggtcaatgtgatggcttcgtagaatcaagtgcaagtctgtggctccattatctcaactggctagaagagagtgctactaaggcagaggtgggagcatgaaagttcacctaatagcttagttttgttaagtctcattgccacagtctgcaccttatcctgatgttctcactggaaaataactagcctagttcctgagaaggaattgtgaacagggcattgcctgtttgtcaaaaagttatttaaagtcactccagctcctcacttaacctctctatgcctgtttcctcttctcgaaaattacagtaataattattacagtaataatagaatagtacctatctcataggctttttgggaggattaaatgagttaataatctgaagatattgaaaaccacacctgtcatgtggtaagtggtcttcaaatgctaattgtttttatctttattaactgccatacccatgtttgattggcagctacatcttgtatgagtctttaatatttcatctgtaatttctgggttgctcctgccacagagaaggagcaagggagccattggtactactgatgaatattaggaggtggagacaccttgacaactgctgaaatgtactcatgcctgcctgcttgccctaactgcacttagtggcctggatttaggagctgccaatctcattacacaccagttttcatgactatcctcaacttactcctttcttaccactgctcagcacttatcctaagttgacaccaggctcattggtaatcatggactcacttctcccatctgaagtattcttgagttggctcccaagaagcattctctcttcatctccaactcaagggtgagctccttttcgtggaggaactaccctgtgtgtcctttccctccctctctccatcaccatcagcattcaattcagtattctgcacacacaggagtttagtctcaatttaaggtaggtcaggtttcattcacccttgagctccccttagcacccactacagactcattggagaggtgactattagaggtgcttgtggaaatgaatctcaaatagtgtccttctgcctgagtccttcattgaatccctcacttgtatacatgattcatactctggtagctttgatcattgtacaaaagaaaagtagtaactcttctttggggccaggccaggactgtggagcccaaagggcttttgtcatccctcctggaatggagttacctgatctggatattggaatgtttacatccttagtccttgaaaaggggaaaagttatgcttatcctcaattgtttaccatgacccttcctgtcacatcatactgttctacgaacacaagaatcatggctaacatttgtaaaccatctactatatgccaggtactctataatggaaggtattttacataaactttttatttaagtctgtgaattaggtataattcaatgcatttttaaagttaaagaaactgaggcttagagagctacttgaccaaaatcacaaggctactaattagtacaagccatttgatctaatactaacactaacttgttgtaactagcttgtcttgctcttaacttcttatctcagtccatttgtgctgctggaacaaaataccacagactgaataatttataaataatggaaacttatttctcacagtcctggagtctgggaagtccaagatccaggtgctggcacgtttcatgtctgctgagggctgctctctgcttccgggacgacagcttgttgctacttcctcctaaggggaggcatactgtgtcctcacatagctgaccttttatagaggttgctaatgccactcacgagggttctgccctcatggtttaactacttccccaaagccccacctcttaatacttatcacattggtgattaagtttcaacacatggattttaggcgacaatcagaccatagcatttcttctctacaggtttataaaaatacttttttgtcttgtatatattttcattatttttcctgcttgagtatacattttcatctctgaagacagggacacatttatggacattccttcctctgctctctaagactgcagtgattttatgtgcacatacatacattgaaaatgtatagttggctagatcctggaccccatataatagcttactggttactatacagcaggaggaactgaagagaaagaaagaatcaacagcaaaggtgcccatacctgttgcaatttgtattttgctcatgtcctagttcagcccatccaagggccaaccctgatagggcttaaatgttctcagcattagcttctcttcattaatatctgtttgtacctttctttgatgccgtatctatcctccataaggtacttattaattttcgcatcatcctgcttcatgttgttctgtccattatctgtaaggctcaaatatagaaagaaagtgcatccatatcagtgagagacagttcagagtgattgtgggtgagctcatggtttcctgcagctgcaggactagagagagctacttcatgatgttggagatctggagtttaggaagcctaggaggtattcaagcagcagtcagtcagcttgccttgcatttttaaaagcatgtctgcaattttatggtgtgttctcctctcccaccactgctgttttcctccattactgcttaggttgctaccctgagagagaagcagccatgctgattctttatcttttaccaaaagggcagcagcagcatctctttctaaattgttattatgaagagaatagctactgtggtttgaatatccccttcaaaactcatgtaaaatgtaattgccattgtgatggtattaagagatgggacccttaagaggtgattaggccacaagagctccattttcataaataaattaatatcattatttcaagagtgggttgttataaaaacaaacttgcccccgtctgtgtttcagtctcaccctcacttgcccttctgcctctgtcatgagatgacatagcatgaaggcccttgtaaaatgtcagcaccttgatattgaacttcccagcatctggaactatgagaaatcaatttgttttcgttgtaaattatccagcctatggtattccactatacaataacaaaatggactaagacaataacccatccacacgatacaatgcatgatgtagaaagtaaatacattgaaataaatacaatgcaaagaaggtctttgttatccaagacgctctgtcctgttctgcagagttaacaaccatcatatctctcatatgatacttcttactagaaaattcccaggcgtacacaggtgtgtgtgtttcacccctttttgcctttataaatggaattggctggaatgctgctgagatcccagctgctgaccctcctgtcaggtgccctgtggttctcattagggcctctgggatactaacattcacacaggcaatgtactttcccttcctgacgcctctggggcccacccgggaccgtcaaacagaccctgcaaagcttaggagatcaattccaacagaagtccagagccatggtgctcttggaaaaatcacaaaccaaaatatagaagtaagactttttcttcctaaattttaggaagaataagaaaatttagtggacttatttgtccactaaaatattaaatgtgaggagaggggaaggcaaaactatggatgattattttcttttttttatatttctgtaactttaaataaggatctatatttataatgaaaacatttatttataatgaaaaaaacctcaatctatcaaaaaaaaaacaaaccccaaaaagtattgccagttcccattgaagtggaatcttaggctctcaacttattaaatgtactaataaagtttttattggtaagcagatacaaaatcgctttataagaatccccagggaattactaagcattgttttgtaatagtaaaattggatcctaatgagcatagtggtagaagtcactgtctgcagaaattagaaatgaaatagagttgattctgggtatgtctgcattgaattagtagagtgtcttggaaagcttgctggactatgatgtgcacggtgggtaacaggatctcccagggtgttcaaagcagcatgattccatccccagcttgccctgcttgttgaaaatcactctctaggacagtattttctgtgctgtgggttttagcctctgtgggcctggaatattactgctggtgactgtggacccttccaaacataacatactgtctgccacaaataacacagttactatttattgagtgtttcttatgtgccagccaccgttctaagaactttcatgcatttacttatccagttcagtaatccggtaaagctaatagcatgttgattaccttatgattgaggaaactgaaacacaaagggctgaagaagattgtctagagtctctcttctattaggaggtggggtcatggttaaaaagagccacctcctaatcactaaaccatgtcacctctcagattagtggatgacatctcctgtatgtggaccatctgtctgtatgtgtgcctgcgattgttttccagatatttgtagagattgttgagattgaacaagcagaaattcatataagagccatactgagtttacatcagcttttggtcatcagtattttctgtcagtggatctaaaatgcgactcttttcttgtgatgatcctccaagtatttggctgttctaaaaaggctatggtcccaaaggctgaacgtcattgttctagaggaaggattttcctgtgatgatcctccaagtatttggctgttctaaaaaggctatggtcccaaaggctgaacatcattgtcctacaggaaggatttggtcatcaaacacacaccatccctagttctttcccaaacagctctcctccagctctgtcatgtctccaccaggatcaaatggcatggtctctcattctttgtgatgtagacagacactggtgagataaattgataagcactgctttgggagtcatctgttgaaatacaaaaataactttgtaacataacctccttctccttagaaacaattattggaggaatttatgaattttacatcttgtgtgagaggctgacagaacctccaatcagaaaggccgtgttctagcgtcaaatcatccatcatttgtgtaactttcagcaagtcactctacctctgtacctctgcattttcaatttgcaagagtggttgcagagttaaactagatgatggtattatatacttgtttttggtttgtctatttctttattttaaagaatgttcaatatctactccataacaggcatagcattagcttcaggatttccagcagtgagccaaacatacagagccctagttctcatggggttgatttcctatttgaggaaaagagacaaaaaggaaatatacaaatacatacattattaggtggtgataaatgctatggagaaaaataagaagaaataggggagataaggggggggggtgattaatttatgtagacattcaggaaaggcctcaatgttgaagtagtattcaagctcatacctgagaaaattagagcctgagccaaaaggctatcagggcagatggtcacaggcagccagtgcaaaggacctgaggtgggaatgtgcttggtgagttggaggcacaggaaggggcctgtgtggctagtacagagggaggaaggctgagagtagagatgatatctgagcttccaaggggccagagaatggaaggtttgggagtgagacggagccatggacaaattgaagcagagtgaatatgctctgatttatactgttaaaagttgatcactcctgcggagtgtggatagaaatttagggacaagggagggtggagggagactagttaggagactattgtcataatccaggtggcttggccatgaagttagtggcggaagaggtctcattctgggcatatcttgaagctatgcttgatggggttgttggtaattgggtctggggtatgagaggaagggaggggccagggtgacaccaagcatgtgattaaggcctgagcacctggactgatgagctgttgtttgctaagatgggtaaggctgagagagatgcagttttaggggaagggttggatattaggggttcagctttggacttgcatttccgtgtctaggagacactctagtagagatatgaaattggtgatggtatgagtaaggttggagtttagacaaaaatctaggctagaattatggatttgagaatcattagcatacacatgctatttagaggcttgagactggatggaagcgtagataaattgagtgtagctagtgggggccaaagcattgattctcttcccaaatgctagggagccctattacttggagcaggaattgtcagacagtgaccagattttcatgtctttttgtaaataaagtttaattggaaccattcatctgcatttctttatctattgtctgtggctgttgttgagctacaacaggagagctgagtagttgtgacaaagactcatggcctgccaaaggccaacaaaatctaccatctggctgtttagagacagggtttttgtttttgtttttgttttttttgacccttgatttagagatcaaggagataagaggcatccagcaaaggaagctgagaaggaatagccagagaggaaagaagagtgccaagagttctgcattgaaggaaagatggtgccagggtttgaacacacagcattagaatacgtgaggctgggcaagttacttccccataaggacggtagtagcacaggattggcataaaaattaaagtagatgatgcatgcaaaacacttacagctgtgcctggtatccagtaagtattcagtaaatgctcttacagcatctacttctatttgcttagtctgtagtcctcagccaaggctctgtactggagacaaatcaggatgtttgaggattagccccaccgcctgatcaggtaagcctatgatctatgctcagggacctgaggaagaaggaggaaggtgagccatgtcccccgaccctgaccgtgtacaccctgtcccccaagaggaccttgaagaagagcccttcagcatctgctttttacttcctatctttgacaaacagtctttatggaaagcttttgagcaaacggcaaatccatctttatgagattactaatgtcaacacattttgtgtatcaggattttataggctcctgcgggcctgtgcctgtgacaacattggctggcagtgctcgcctgaggaattatgcaacatgcccctgatgctggagaaggatcttgatatcccactgaggcccgggacattttctcccagaaacagtcttgaatgagaagcttgaagaggggagttagatttactggggcttctctaaagattctgtgtccaaagcttgaatagggaaagaaatactttgcatccatgtagcaggttctgcattcagcataccaggtttgctcctagttaaagagtcatggagcccatgggagtgtttgttctttgggaatgtcataaaagagaatttggcctctcccacttacatgttcttgcatttcttattggtccttctcttgcaattattgctactttccctggtcaacctctagagcagtggctttccaagtgccttctgtggacaggtagtatcagcatcatctagaaacttagagacgcaaatcctcggtgcacccccaacccatggaatcaaccgtttttaatgtgtgacctttggcagattagttacccctctgaaatctagtcttaccctatgaaatatgggaacgttaatagcacaggattattgtaaatattaaatgagatgattttaatgagtcttccaggcgattctgattatgctacagttccactcctaaagattcttctaaaagattcccatttttggacaattagaagttcctgctaagagaaattttcagattttatccctctacacattcgcaactatttttaatctgagctaatctgccaatcatctttccaaaatgaattaatactctcccattttcttaaaaattttgtaggatatcaaccattttaaactttttcttaaagactcagggcatcatcatgaatataattattgttatattagatgttgggcctttgtcatatttctatattttgtgttgtttaccagtttttttcagcttctttaaaaatagaatctttagtttgctaccttcttcttcattgtctggatatcagctatttttttaatagctatatccagtattatccccatcactttctaattttttacttttaacttgattttgcacaaggactgaaataaccaagatgattaataatgtactcaaagcaagaataaatcattaaacataatagtaaataaatgagaagaatttattgagaggaaataaatgagagggattttttttgaaagtataagcttctgtacctgagttttgcatcataaagtctggattcttgggtaccttactatttacttctgatcatgtcatagttgtcttgaataactgaatagctgatgttttgaataaatgaaaagtttttgtagcatactcaccactcaatcattctcctgaatgttccaccctcatcatgttatacctttctatcctttgcatatattgttgacatatacattttcctaggtgatacagtttgtaactgatatcatccaatcacaagtaaattactgctctgtggaataaaaggtaataactaaatgggacatgtctcctctttcactccctttttgctgttgttccacttctcctgggctcctgatgaagtctaggggagagtatacagggctgagatgtgaacaaccctaggatctaggcttggctctgccactaagtgactatgtagaactaggcaaatctcttggcctctctgggccatgagatgcaacactataaatcagtacgataatactcgcttctccttccttatagcagtagagcaagaatccaaataaatagtacaagtgagaactcaacacaatctacatctgtgaagcatcattcttaaggtatatccagggcatttggctccacgtagacctagaggttgctttctcagtcccttgtccgccccatatccagctgccttggctcacagagtttgagactgtgctgtattttctgtcatgcttcagagtgtatcaaatcaacacaaatataaaataaagccataaagagaaggctgatattcaccatagaaaatgttggagggaaagacaaaaacactcaacgacaacttcacaaacaacccttattatggctgtggaagacacaatagtatgtgtaatgtggtgtttgggctgtatttgctgcttgggaatctggtgcattctgagatggagggaatgccaagtgtttagacaacatgctgcttggcgcctgcaggttcctggaaaggactggggtctccagatctaggctgccagccaggagtctcaggcagagacatgcattctaccgtttaaggcctttctagacttcagcagtgagcagatacaggagccctcaagaagctctgcaaaagcctaccaccactgagatccaggacataatatgcattcctaagcaggctgctgcctttggctgagtctatctgggggccttctctctgcaggagaggatgctaacagctactgttcctgaaggactcataagaagacttctgtgcacttccagcctcccacatgaagcttctggaagggctaacccggttcatttcatctacttgctgcctatgccaatcctatcccctcttcaaagcccagtttaagtctgaccttccccatgaaatcaccaaagcctttagtcttcatgacccctcctgcctctggcggtctcttgcacttgttgcctgagattctcttaagctcttttcatctgctgccttgttagttaaatttactctgagtgtgttttatcttgtttcctcagctggattgtctgcatcttgggggaagggaaagttcttataaatcctggttctgctcttgggccaggacatgcctggggcagcaggtgtgtcttccccacctagactgaggaattgtgtctcaggggctgggctggattccgcaggagggaggccagggctgccaagagcaggagagccagagaaaagaatcaaatggccttaaatttgatttaagtttcaaattgcttgaacccaggaggcggaggttgtagtgagccaaatcgcaccattgcactccagcctgggcgacaagagtgaaactccgtttgaaacaaacaaacaaaaaaacaaacaaacaaacaaacaaaaacaagcctggcaactgctgccaagtgtctcatccaaagaaggaagggggatcgaaaccaaagaattgtgaagtcacaggatcaacagtcaggcaagtggctaaggactcaggctatgaagggtcctctgccacggttaggaggtttctttgttgttttgtggtgctctttgtggtgtagaaacaggtcatttctctacaaggattcatgcaggttggacagttccatcatggtctgctcccaagcatggggcctgtagaagtaatgacttttcttctggtcccagtccacaaagagatcgtgatcccattccccttacctgtacaatgcaggggtgagactcaatcctttcttgagtcccagtaaatgacttgagagattgtgagcagaccaatatcttctgtaaatgactggatattccagggaatactttcaaaaagcatcttggacataaaaacttttttttttcataagcagtggaggcttggggtcaaaagctagaccattcctaaaggaaagtttgatagtttcttctttgggagtgaaaaccctatgcatttaagaacagaaaggaaagcttgcataggtctgaaaatggaaaataggcctatttcctttaagaatagtaaatttcaggccagatgcactggctcatgcctgtaatcccaggactttcggaggctgaggtgggcagatcacttgagatcaggagttcaagaccatcctggccaacatggcaaaaccttctctctactaaaaaatacaaaaattagctgggtgtggtggcacgtggctgtaattccagctactcgggaagctgaggcacaagaagcagaggttgcagtaagccaagagcaggccactgcactccagccagggagacagaaggagactctgtctcaaaacaaacaaacaaacaaacaaaaaaccaaaaaagaatggtaaattccaattaacaacaggagatggaacaaatggtggacagtgactgtcatcagagaagtaaatgctatgtctgcaaaaaagaggtgagggcacagtgatgcgtagagacccctggctttaattatcccatgccttggtgttactggtcctctggagatctacttaacaggaagtagtgagctatgtccccacaaaagcatcccagaggccatttctgagcaggatggcctgtgggagtcgagtggtcagttgccatggttagcagagatttcctgctgagaagtcgcccctatgtgtgcacatggacagtgttgggtagagcaatgctccttcaactttagtgtgtttaccatcacctggggatcttgttgagctacacgttctgatttcataggcctggagtggaacccaagactgtgtttctaactagcttccaggtgctgtccatattgcggggctgtggaccacattttgagtagcgtggtgtagtggacactggaggaagaagtgtagacctgagctctagccccagctcagccctgtgtgtggccctgggcaagtcactgacactctaagactcacaattatgtcaatcatagtgataaagggaaatgaactagaaagactctccctggttctatgatgcgatgtttctgttacagtcccacagagaatttagacctctaccttgttcttccttagagtagactgttggccctagagatgtgcccagtggtcatgtaacatggagatatgcttgattaattcactgtacatgggttgtttgaccagcttctacccagtgcctataagagtagataccagactctatttttatgtcatttgaaagacaagggtagaagagacagcagttcagtgacagttgcgccatcgccattactctaatggttcagaaatagcttcccctcttcccctgtggaatgtttagattcatacttttaacctgtagcattttcctacccttcctgtgtaggaagcaggtgcattggaccaccctaaaacaatgcgtaggcctcagacttctgaactcatttctctgagatgagatgtccagtttgttcactacaacaatagttgccagacctattacggttatgtaataggtttctttttttaaacaggtcttgaaaatgtatgcattattctttaggtaataaatgaaatttaaaagactgaaaataaatcagctttgcaaagtgggggctgaagcttttctactaactgaaccatcttttcttttttattcttgttactttttaaggagatgatggcaagtgatttctttttaacccattttaagggcccagttcatcttgtacaattcttgtgcaaagtctctactgagactttggcctgatgcaaaagaagaggcccttagagaataatgctgggcatggagtgtgattcaagaagttattatcgtgtgttctctgacacagggtggctcttgctccccaagggtccaacagagaggggcccaggcatgcagaatattacatgcctgccctgtttccccatcagagaaatgttttccaacagccattgtggttgtagtaaggaaaaacatgtctttctgcctggatatatcaactgagggatgaacggtgagagaatataattgtctaaggatgacaacaggatcaatttccctttgacactgtaggccaccacctctttgtctccataaaatttcattagcacttgaatttatcagattggcttagctgttgtgcattctgctctgtgtgcaacgggcccattgttctactctactttaactggttttctgatggatgtgtttatgatacctcctgctgggtattgtgcgtgacaactggggactcgataactaaacaatatctgaacgcagaatccctctgtccagggaggggctgaggaagtcacaacagttaatctgtagtaggacccatgtcctcccatctgcaggggatgctctgttggcttgcaaagtggaaagatctgggaggctgaggtctgatgtcgtcgtcatcggcagagcgaccttgctcctcatttgtgcgcacaggcactgaatggagggagccttgaatcatctgattttgctcctcattagtatttctccactgtgttctctgaccacactttcctcctcggtgcatgcaaagctattagcaatgcacacacgcggcacatctgtggagccattattgctgctggatagctgtgtttgtgtaaaatattgaacaccctgtgaagatttataatggtttcccgccctgtcctctatccaccccctcttctctatttaaagacatattaacatctctagctctacctggaggaaaaactctttgaagtgagactgcacgaagataaaatgccttctctgaaagcgtccctctagaatgagcatggaggccttctgagaggccagggaaccacctgaggcacaggggcaggatgtctctgctggaaggcctcaggcccctctctccctgctttctgtccctactgggagtcagctctcccaagcacaggctaagcacccttgtgaccacagttatctggcccttgtgagagcttgctggtgactttcctgagactggagtcccgaggcttttaacaatgtggatgtgccttggccaaaagacatcctctgggttccttaatacttgtcttcactcttctgttttgtcagtggagatgccagtagctgtaatttagtcttgggtgggagagagccagaggtcgaggagggggtggggaaattgtcatcctaacccagcatagaggacctggtttaaagaggcttaacagaccactggtcttaccagcagatgcacctggggcttcgagagtgacttgggcttagcttcttcaaagggtgctgaaatctctcaccacccctgctcaaccctcttgctgcccccaccccaatggagaggggcccaggcatgcagaatattgtattccaacgatgctagattcatgtgcatgatatggaagggtctggagggaagaggctgctggtgcctatggccctgaggaccagctttctccttcccccatgtccccaggccaccccacccagagcatgccctcggcacgcaacaagcggcatgttccaggttgttccagggccagagagagtgacatgaggcaatgtctgtggcaagcgaaaaatgtgtgctgagccttgggaggcgccgattggctggcagtgaggtaatgcaatgcagtccaaatgtggaagcagcagtaccagcatcgagggcgtgcctcctcggcaagcctgagtctcctgccagccatctgaaggacaaggcgccgaggggtgctgcagacctcatgcaggtggctggctcacatggcagggtctgggtggtagagatcagatggcaggatctgagttgtcatgtctgttctctgtccctgaacacaccaaatgccactacaattctgatctctgttcttcaatggggatctcttagtggggagggcaaagaagcttgaaaatgagggtctggacctcagaaccacttacccaggtcatggtgagtgatggtcaatacaactactcttgaggattaggatggttttctcagtaaccgatggcttccctttaatgatataaaccttctcagggtctttcctaagcacagttctagattcatatttgggccagaagtccacactcaatctccccattccagtccatttcctatgactttgtgtcattggcaatgtccgctacgaaggatggaggaattcaagaggccactgtgggctatgctttcttctctttaataagactcctgttccaggagaaaactggcctctcaaaaaaagtcttctgaggaatagcagctaccaggaatcacagttggttccccatgaacatttcagatcaattacataaataataactacctattgtcttctagtgtcagtaccacaggagtaactccacatctttgagttaataaataaatttacttacttattcaataaatattctggactctttacggcagttctgacaatgttctaaatgtataggctatggtggtgagcagaacaaagtccttggtctcatgaagctaacattgtaaagggagatacagacaaaaagcaagagagctaagaagaaaatgaaagaggataatgaaatacagggtggctagtgattgaggcaactgtagttgggtggtcagggatgacctctgtaaagaggtaacattttagctgagacatcagtgaagccaatatggccatgagaagttctaggagaaaactccctgctggccccagaaattaattacaatatgaagctttagggaaggccacagggttgaatacctaagaagaaatatcccagtggttaaggacaacttctgctttgccactcagagagaagcagagcttgtcattgagctagtacagtcctgtgcactcgtgggagtaaggtcgcctcctttccccaggcacacagtaactctgctggattgctgactcctggcagtgtcttgtagcaaggtagactggggggtggcagatgcaaactctccctaaagaggtatcatcctcagttatttccattcacccaaaccctttctttcctccaaatcacactggctatatatctgaatgttttctttgacccagatcctattcttggcttctgtagacattgtcttgtttgatccctataaaaatctgcaagatggatgctataatttgcatttgactaaggaggaaactgaggctgtaagagataaggcaactctcccaagatggctcttttggggagacgtagaattgaggtccaaactcctaagaaagatggaactttggccatctccattgaggatgaataactcatcaaactattcctgggaaagggggtggcagaggagagagagatattgagacaggctacatatcataatatcatgggttaaaccaacagcaattttagaccccaaggggacaattcgcatagctgcagacgtttttccttgtcacactggggatgggtggggagcgctactgacatctagtgggtagagacctgggatgaggttctaaatgttctacgacgcacatgacagtgccacagcaaagaattatttggccccagatgtcaatagtgctgaggttgagaaaccttcgattaaagtcttacagtgctcactgctctctgcttcctctgtcttccttctatggctgccctcggggttacttacacactggatctctagatacaggactaaagtcataatggaaatttaagattccatttggatgctgatttttttcccaagctctcttcactatttattaaatggttagtgaagggaggtggaaagcttgatctccaggcaagtgagtcccttggacgtggggtggggagggtgaagctctggtgtggtactgcatcagcctagtgggaggtgcttgttaaccctctgtgctgtggcttccccatctgtaaaatggaggtgaaaatacctcctcctgccacctctcaggtttgctgtgagaagtcagtgatgtgtaagtgctttcataaaagtactatatacgtgtgttattactaattcttatatcatgaataaaatgaaatcatcattctgcccctgacaacaccaatttgctgaaccattagaattctgtacattacagtcttaaagagccatagagagaactgtaagggacctcaagaggtcatgcggtagaaaatggccagtgagacacttgggaatgattaaagtgaggtgggaagacacatggcatcttattcagttactcaactctcctttgttcacttccttgcatcatcattgcctttaggagtaatataataactgcattaataaagttgttatcctcctcccacccctgccagagctctgagggcacagtctaaacagaataattaattaatgaaaatgaagagaaaatagctcaagtgatggctataggagatcaaatagcaaagagaaagctgcaaaaacgttcgttgttatttgacactgagtagtgcaaagagggctgggagagtcccaggatccctgatcaacagagagagagtatcctgggggtttcctctttactttttctttttctgctctgaaaggttaggaaagatcctgagggcataatctgaccatctgatccaggccagcatactgctggagaagactgtgtcggggatgaggtggtctgagaagctggaataaatgcaggatcagctgataaggagggtgaggaaaaggtgagcttagtgtctgactttaaaaatatgtagatgagctccctaaataaaatacccctccacactgtactgatgactgaaattcctttaagagaaaatattttcgttctacaattaaagatagaatcctattttttccagggagaagtaatattgtcttaaatttatcctacattactacatgttgattacaaaaactgaagaatctattttctttgttttttttccagtttttatctccatccccatcttgcatcttacaaaggacccaatagaagcttcatggggtacaggaaagaatatagcaaggaccttggaggcctcaggcctcaatctggctctgccattcaatagtttgaccttggagagcaatcagaattctcagggccttagatcctctgcccgtgaagctgaggtattggactggatatctccaagggccctactaacaataagattatggactggggatggcttttcttctttccattttgttcaaggaagcctcctcttcgtcatttctcacctaccacccagctctgtattttcccatatttcaatgtcctttcatgaagacatataaacagtggccatgagtcaaggggatgcaagggtatctgtggttcaagaagatgcacgtgatgaccacggctagttgatccctcttggcatattgttgccatctcagaaagacaggaagggtgggttacagctgccagcaccatcaggattaaaagcaggaggactttaagactcaccctcgatgatgcagaactcaaaaggtctctgcttcacagctctgggccaccttgaagggcaagttgacaaaataaagcaaagcccagacagccttacagagtagtagattctgcattcctcattttcatggataattactgtagccttcaatttgaggaacatggcagtgatttgtgtgcagtttactcttctttcaggtgatggaaccagagccagaggcgtggatgtgactctgttgccctctagtggctagaatgcagtagcatacccagcaccccctcagacttggcttggtggtgccgctgacacgtgagcaagggttcctgggacactgactgccaagggggctcgggattctttcagcacaactcctgacctgagattctgcagagagagagagagagggagggagggaaagagcatcatccttcctatttctggaagtcagatctgtaacacagagggcctgtttcgtctagagtaaccctgtaccagctgcagcgctgggacgctcctgcctcttctgcggtcgcatgtccatgttttggggcagctaaggcacctggggtctgctctcgcagtcacacatttgctgtgtcacttctgcctcagttagatgttttctctagcaaacagatatcattatgtggttttccaattatcacttcccaaagggagctggttaatatggatgaggctttttaacatttggctttgaagacagggttatatgtagttgtagcagagggagccaatatctcggtaattggctaaggtttgcagaggagcaaggcagtctggggtatgtgccatctctgggacgcggggtctttgcagaatgtgttattgtggtgtagtctttaagtgagttctcagataaactggaaggtgggtctaggtggagattatttcaagaaggttagaactctggtctctggttacaataaaaaagctggattgctgaagatcatatgggcattgttgatgttgggctcaggcagagagttcttagtagggtcttcttaccctgacggttgccctttgtaacaggcaataatacaagaggattaatttatggagaggctgaagaggttagtggaatgagaagagatgcagcatgcagggacaaaactcagtttactatatcagcttcttttaccctttgggacaagaatccccaatttactgggcaaaacttccctccttctacttcctcttccaagagtttaactcatggaaaggaaatgaggggaaatagcacatttcatggcatcgaagagggcatctttgaaacctagcggctttccacctacagacatttagaatgcaacttatgctggcaaagctattgagggtttaaatgatatgctttatagcgtgttgcatttcttcctttgaaaatgaggagcttgaattacctttcttgcttcataatagaaatttagtcttatttctcagtctatagttaacacatagcaatctggtgccttcgagtgacaatttacctaaaagtcagcgttacatagatagttctacaaaatccaaacttacatgctttgtctgtacacttcttggtcttccaaccttcaggatcaccattgattccttttcctgtacccctccaacccctgacactgttaaactccatttcagtagtcattcacccagtcctgcagattttttgtccctacagcctaacattagttttcaaccagatcactctttttttacactattcaaaaatttctttagctttaaaagccctcatgagccaaagtgccagagatacttgtggtgttctaaagtatttgctgggacagggttaaatggatagggaaaaaaagaaataataggagggaaaagggtcccatgaaaagcttgctgcctggtggtggggaagatggagtaccaccagctatcattataggctgggccaggtgataggcagaataaagtgacttaagaaatttctggaagcacttcactgcactgcaagtcatgccactcttcctcagctcacagttggcagaagcaccactataaactgggttcagccacgtgtcccttagacacataagagagggagtgccaattgggaggacaggtgaccgaggggggcagagggacacattcatttattacccagttttgtcctggattgatgctggtcttgggtatccgacagtggaaccactctagtacctgacacacctactcttgacccagctttttcactcccaatttggttgttatacagcaccacaaatagggaaagatggctgggactttgaagagaacaggtggctcctatcagctggtgctaaaagagccccaccttatagatatgtatcttacactcatatgaccttccctactacaatactgtcataaagtcaaaaatgtgtgtctcttgtccctttgggctcccccagctccatttaataccgttcccaatgtttgtacctaattacagatttgaggagtcataaaaccacatctcccaagaggtagatctgctttattttggcttctgtgacacctgattgtcctctttcttcattcacctttaatgatttgcttccttttgttgcttatcaaggacttgtgctcctgaaggttctgtccttgactcccttgtcttcccccaacattatctttctggacaatctctaccaccttaatgttaatgagcctcaactccaaattggcagcccagatcaccctccagggctctggacatgtgtccccagctttctattagacatctctacctacttgtcccacaagaacctcaaacaacaaacatctaaacctgaatttatcctctgctccacaaaagtcacttctctatttctcattagaagtatagaaatggaagaatgaaaaacttccatccattctatcacttggtattaacctagaccttttccccttgctcaaccccatctctccttttgccttttaccacgaatctgtcaccagatcttacaattctacttctcaaatatctttccagacagactcttcctctccatgtctactttactgccctagttcagggtttcatcaccttgatctggcctttgatatctgcctccatgtgtccaggacctgcatgctaatccctgaaagaaaacctggatacagttttgcagctgaattttattttaatgaaatctgcattcttgtggataaccttccaacacactacttcagtaatatcactgactgtagcaataataataatatcagtgactataacaaaaacttttggcttaaaaaaaaatccatttgcaatgacttcactttccgaagttctcaactgatacccagagccattctttttggtcatatgccaattttgtgagtaaaatatagggtttctttatgaccatacatttcctatgatggcgagcttatgagggtggtccttcatgcaagtttctcatctttctatagcctgaaaagtactgattctttttttttttttgagatggaatctcactgtgttgcccaggctggagtgcagtggcatgatctcggctcactgcaagctccgtctcctgggttcacgccattctcctgcctcagcctcccaagtagctgggactacaggtacccgccaccacgcccggctaattttttgtatatttttagtagacacagggtttcaccatgttagccaggatggtctctatctcctgacctcgtgatccacccacctcggcctcccaaagtgctgggattacaggtgtgagccactgtgcctggccttgattctttgaaaatgaactctttttggcaccctcatcttctgccatcttggtccattttgcttatcagagtaaatacaactggtaaaaaggtttatgctatttattctccctccagtcttggttcataacatgctcagttaaatttctccctcattgagtgtctcctcaaagataaatattttaccttggaaagtctggtcatttctaaggttaggaaaatgctatcagtcactttggagttgattgcctatgtcaggttggcattcttggatgaactacaggtttaagatttgctgttctgcatgcatcactgtgaagtcatctgagatgggcgctgacctgtagctcacaaggagtttcaaggtcttctatcatcctcctttcaaacactcacagtgattaattctccagaaatcactactggtgctatcaccttcagaaaacaattttctttctgaatacatgtagggtatataggcttctctggtttggtttgcatttcacattagcctttttttttttttttttttttaaattccaaggaactctaccttcaaaagcaagcaaagcattctcctcccaggtggcccatgtactggattttggagtctgaattgttatttcctcactcctgccttcctctcttcttggctttctttctagggcacctgacgtccttccttattactgatggcagcagagactgaacccctgggagaggaaagtgaactgagtaattgttttgccttttcatgtctgatgtatcactctgggtcagtgtagctttagttgaaagagtaatgttgttacccaggagcagctgtagtgtctccagacaactccaagacctctccagtcccgcagaggtcagtttctggtctgggcataatggtcttttttccaggggttgaagcccagctagaagcaaattcctactctgatttctcaagactctgaacacccacaccggcccatgagggcagagagtggtggctggctttctaaaccagccttgtgtcttcagagtccttgatcagagataacttggggaaagctgtgtctcataaatccactttgctactgggtcagagagatgccttgagaatgaccttagctagggaagggatggaatattggtttccctttgtcccctgcccttcagttcatggcatagggttaagagagtgtcaggagcctgcaggcctgttctgtgcttagcgtggggagacatggcagcaagttggcaagctggggtcttcttattccaaattcaaccatttcttggcactttttttgtttctttttctgagaggtagtagacagtggagctaaataaaattttctcccaagaaaaaatggttagaagcagcgtgtcccctgcccaggcctgaaatctcttcattccctttccctttccccagggttcccaaaggtcttctgcattgcccacctgctgctctctttcctgccctgtttgttttgatggcattaaaaggcctgcctgcctactttacaaggaccctcatttctttacccatcatgttttgatatattttttcttgctttttcttgaggtttgcaatcaagagccctttaactgaaatcctgggctgcctgcagcagctgtggggttcccagccaactgccttgtcctctgagggataaattccctttgaccgtgccacttgtgaaaacacagagcaagtgtagagtattttacatataatttagaaagagagaggacttatcggtgggtggtaggaaaggacagaagatggattaatattttttctttatcacttggcatgttaaacttaattatatttcttgaaagacctctaaacagttataattagaaattatgataatagctgcggttgccttacacatgttcattttactgcttgcttctttgtgaatgtgggctgtgattaataaataaccaccaacatcattaggacaagacctctccttgcctgctgggacccctttgactttggatggacagtgtcaaggatcaggagcacctagactagccccatgagccatggccttcataggctagatggtcattggaaatgaagttgttggcaccgacagtcacagttatgaaaataagaatttggatctcagatttttctgctccctcttctcctgtgtattagtccgttcttatgctgctaataaagacatacccgagactgagtaatttataaaggaaagaggtttaatggactcacagttccacttggctagggaggcctcacaatcacgacggaagatgaaggaagagcaaagggatgtcttacacggaggcaggctagagagaattagagccaagtgaaagaggaaacccattataaaatcatcagatcttgtgagacttattcactaccacaagaacagtatgagggaaactgcctccataattcaattatctcctaccgggtttctctcacaacacttgggaattatgggagctacaattcaagatgagatttgggtggggacacagccaaaccatgtcatcctctcttggtcatttgttttttttttttttgatttacaagtatcgtttattcactcacttatttttgtgcagggatgacaagagagtcacaggaatatccctaaatacttacggtatcattgtaaagagaaataacccaagaagagagtgaaaaaagaacctcctaaccaagggctgcagttgagtactaactactctgtggtgagaaataggaaatttagtattaagttaaagcaaaatcctttttaacatttctgaggtctattctcatgttgattataaatgggaaaagtgagaattagcttacttctaacctagctgcctgtttggccctgcaaaggattttagagatccccttcattctgtttattttatggaagaggaatttgagtctggaggagttaagacattgactgggcaaagaggcccaaccactcatgttcagacctccctgtgagatgccatataagaatatcaagagaaaaccttttaccctctaggctgttcaaccttagaaattcataagagcccccttagtagtcaattatgaatgataacaataaagatccatgttcaaagtattgaaagcactgtttcaataactttcttacagcatgggtgtatgacagaccagagactaaatacggagtcctaattctcaagacagtctcaaaggatattcaagatcaaatttagaaaatatattgtcagaagcctgttccccagagtcacattcaaagatttttctcagagaaattttcctaaaggcatgattctaaagagatctagtacaaggcaaaggatttcgattttttttcccctactacttcctcatctccaccccacaagttgacctggagtcatctttggtccttttgagttttaagtcatcatcttccctcaggctcaagaggaagcctgctgtattttgatgagacaactcacctttgatgtcacagttttcactcttcaagaacaaggagtcattagtatcttgacatctaactgtataagttaaagcacttcctggaagctcaaagggaaacactgaactcttaacacacagattctgctggaagtaaatgactctgccctataaaaggaggagaaagaaattctatttgagtaatgccgttgaaatattaaaagaaattcagagggaaaaatatccaagtgaataatatatattggatctctggcctctaatttgacattcaggtcagatcaaaactaaccctgtgagattctggaatttaatgtcatataaaaatgctactgggcaaggaactttattacacatgatcataaaaatatatgggaggcgccatctctgggtatttttctatcaaatctttactcattttacagtctttacaaacagaagccagaagtgctatatttgaacatctacatttgttgggatttctttaaaaaaaataaaacaaaaagaagaatcacattttatacgtgttaaatggtgtagtagtaaaccatgtttaaaaaagcttcagttttcattggtgtacaaagctgctacatgtaaatattggaaccactttttaaaagaggattgctgcagtcagattttttaaaataataaaataatcacaaagttcaacatatggtgtcttcatgtgattataagtgtgcgagtgtgtatacatgtttttaattccttaggattagcagaatgacaaaatgtgtgaagaaggatagatgatggttatttcaagcagcacaagaatttgaggaggaggtggagactaagaagagagaggaaaaaaagatcaagcaggacaagggacatgggtacaagactagaagaaaagctggatttctttaaactagaaaaatcaaagacatctgttccccttatggcaataaccacatttttctagaaatttacacattaacatctaaaaatggatttgtgctaaaaatacaagctatgctcaatgcatgactcttgaatgactttcccctatgattcctctgtagtcatatggcaaggccatgccctcatctgacattttttttagtcaggaaataccaacttcagttttctttgatcatgtgatttccttggcctggaaactcttctctgtctttccccctaaccaactcttactcattcttctagactaactcagctctttaatcactgagaaaaccttccctgcctatctttgtcccttccttagttttactgaatttgcctgccctgtactctgatagcacattgtatttaaataaacacttacggtctctcccgctaggctgtgaacttcttaagtgaaaagccatgttttattgaaatctatatttctggaacctaacacagtgtcctagatgctcgataaatatgttttggactaaaatatgctgctagtttaatgctccagttcctgatgaagccagggctttctttcccaggagacagtcaactcagggggcatgtttggtttagtacctgccagcgtgttgttgacaaacaccatatactctctgttgcaaagccaaaacatgaccttttccacaaatggagtaagcgtttattggggaataaaaaagtatgatgattgtttttaagtaacgtataaacctaagtgtctcaatagaaattgtgagaaatatttatttactgcgagagaaacattttccttaagctttcattgttttaggtagtcttcgttttcctgttccccatcctcctaggttgaattccctgattctggctggcatgctcataatttctatgatcacagccccattgtctgttggagctgagggcattgtaagtttttgtaagcagcctttgataagttttagaggtgtagagaaagagctctgtctcctccctgggagaatactcctttccctacacctcagaggaccaaatcatgtctttattaatatgaagcattcattccagtggcatattttattcattacaagaggatcagtagtttgagcaatcagagatgaattctaatatatggaatcctttcccgctgagcttccatgaaagcatttgatcctttttggcctgccccctttgagctggctcctttattaatcctaaaggaccaaggtgtaagaactcaggcaggacaactgtctctttaggcaaacccaggctttgatccgcttccctgacacagtgatctcacctcctttggctcagtcctctccttcgtcattggcccagctatgagtctggaagtccccacagtgccttctttgggtcaatactattatcgtgcacctgctatttgcctggtgctgtgctagagactcaggatacagatgtgtagagggaagagtgtttattcttgtgaccttatcatggagagctttcagatgagatttattcctaccaaatttattatttgagtgaaactgaacagttccattctgataagtaagggaagaaccaggcatactatgttgctattctccacgatctgtgttaaggtttctgtggatgtgtgtgtgtgtctacttaaagaaatggcagtctatccctcttacatcctcagatattcacagagcccctcagtgacattttttggcctaggctttttaacattctagagtagaagagttgactggtaggaacatttctaagtgctcttttgcaccataaagcaagaggagtgtagctgttaggggaacttgagaagttggttagtgtgtaagtgatgtgagaaaattctaagttttccagtttaaaaatggagacaggagggaaatggccctttgttaagaaaataatgttaaggtattaagaaaacaatattaaggtataaagaaaaccagagacatgaaacagaagttggactctgagagtcttggcggagatggtggtagttttagcctgcataggtctgggataggagtcacttgctgtccactggcatcagaggacacaacggagtctttgatgtgggtctgaaatgttacaacttcccacccccacttaaggatgcttggatggagaataagagatgtcagttgtgttctgaaaaccctaacctagatataccttcagccaaaagagagacatgctaccatggttatcatccaaagccactctgtagaatatagcccaaacatcactgtgtattaaaacatttctctttactgttttcacataaatagattaatttatacagatttgtatttatttacatatttgtgtatatgctgcactaaatcctcactagtgggacattgtttaggaatcctggtacagggtgtagtaccaacaaggaaaaccttcttattaagctcagtgtcacttgatccattatatttaatgccaggaagggtatatatacagatttagaaattaccttatttctttgtcgactgagatgggtaatctactcaataaccatttaatgacaatgcacaatgttccaggatgcagaattgaatagcctagcctgggtcgctcccctctgagaagattacagtgtaatatgataattattaccatagtgctacccctggggcagaggacactcagagaaggggtatctgatttagacatggggatcactacagctgcctggaggagaggaagcttaaactgtgttgggaagtgtgagtaggacacagattggtaaggtgggggtggagaggtattccagaaaaagggctgggcatagggaggcttgtagcaatctacaatatttgggaagctatgggtgggttaatactacgggcattaagtatgctttgggagggagtgaatggggataggattcagggcacagctgggccaggtcacgaagtaaataagatcagaaagactttgaatagctcagtcaggatggagattcatcttgaaactaatagctggagaccttgattgacttgagaaggaagagaatcatgtgatcctatttacacgtggaaagatcatgctagctgtcatttggaggaggaagtagttaagggcagggtagagataggcagatatcatgagataacctccatgaaaaaaaaaagggtgaggtggcacaggtgaaagtaaacttaggaaagtaaagccaggattctaatgaaagatgttattaattaaacttactgtttaggaggatgatggagaaacccaggtcctggcaaaaacggtcacactactttaaagtttgggactaagaaggaaatgaataggatatcatgaaagtaggctctgtgattttcttagtttgtagggagatggtagaacttagtggttaagcacttgagctttgagctctgaaagatgtgagtggattcctggcctgatctcatactagctgcatgaccttggttgaccttcagcattctcatctgttgaatggggtaataataatatatgactccaggagttcttgtgagaatttaatcagaaagtacatgttaaatactttttggcacctagtaagtgttcaataaattaccactttgcttatttttataattggtaattaaaagccagcaaaagtatgcttgtagtggaaaaggcactacaggcacaagtactaatggggcttgggctgccaggaaaataccctgtgatctccttctgatacctggcacacaattttcagggatcttggaaaacgtttacctcatatgcaagtccatgcatggtaccagcaaacagggatccttgaagaagtgaattcacagctgtctttaccttctactatgtaacagaatgtgagatagagagaaggagagggaggagagagggagggagagagagagagagagaggagagagagaaagaaagtgacaaattagattatggaatggaaagttacatttgggaaggtgaagagttttgtcaagtatcttagcctttcttagcctcattttaaaatgatgttggactaagtccagctgcaaactgacagcccatgcaactagcacgtggaaatattttaaaaagctgagccaacgtttaaaaattggaaatttgtcaattgaggtagcttcttccataataagttcatttttattatttattcaaagctaaataattttattcaaaaatagatttctggattctgttgaaaaatcctaagatctggccaaccaggctcctgctcttccaagggcgtaagcattgctgccccttttgggcaaagaatcaggtttctaggtcctcaaggctcatcacttggggtgtgtgctggtctctcatgccaggtccccttctcttatttgcaaactgtctctgtttgatattaaaatttgtaatggggaaacactcactggtttctaaaaccctatgtagatttaagtagttgatgattctgtgaaaaaaccaaataccttctagagaaaacatacaggttgggcagagcccaggtattgatgtccttgatgaaactggtttttgtattctgaatgttggagattgagagatccaaagccattctctaaggttgacaccaaggtgcaggtgaaaccatggggggcaggtgtggggagaaagggaaggagttgaaggaagaaatctacaattactcggaactccacatccactcagctgctgtagaatatgagttgagaggaaatgcagaggagaatctgctgcataggaccactggaatatagattgtgttttggaaatgactgatttatcaggtggaagcagagaatgataagccagctccatgctgttctctcctttgtcatgttcccctgcccctggcccttggccttcctctcacttccctccctgacaccccaactccatgcagcatttgctccccctccacccaactcctccttgctttcctggcaggttcaccaagaaacaaccgggcctccatggcaacgtgaagacagctgaaaaatggcagctaaatgcagctgcccctcatttaatatcgactctggcactgacagaacagataatgggcaataacacaccattatgttgtgggaaaatgaaatgcttcagcagaaggctgtcatgctggggggatttatttgttactgtaccagcaccagtttctatttacttcccttccgttctttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcacattcaaatacattgctttttcatttggagggtgaggcaaccctatgaagacaggtagggcctagacactgatgtttattttgcagatttttaaaggggctcagagaagttgaacccaagatcaggcaagtaagtgtcagcagctgcattgcaagtcagattttctagcccctagacaggactctttcctttctacgacatgaaaaacttcagagtcaccaatttctacccactttactagcaccctatcttcttactgaataatctgcaggtgcagagaaagtcttctaggctttgagacttcagaaggtctttagatctttacttatattgccagtcacttacagattcttccagacaagtgcctttgaattgttgataagattggtttatttttgttttcatttttactctttaaacccaagacgtctatctgctcattacctcctattgcatcattatataatcatgaaatcttggtatgcagaagggcgtggtgtgctctttgacttgaaagtgggggcattttggtggccaacagctttctgttttgcaaaagaccgtggtacattgaggtccagaggacatcactgatggacttggcatgaggaaaacccttctctaagttgttgctgtagtttaaacttgctttcttacatcctgttggttggattgtcatagcaccctcatcttctgttgaaatatcatttagtagactctaaattctggaaagatctgagatcaagtttcttagttctttgggtcttgaaaggattacaaatggagtgagaatggctattgcaaacatgttttcatttctagttatggctggtgagggaagaactaaatgtcaaaaaatatatgtgtacatctgtagaaggtacagtatgagtaatgaatatagtggttttcaatcatatgaaagaatgatttatattgataaagagatcaatgtttgtacttcccagcaaatattttttaacctgggatctctgagccccttgaaaacatgtgcaaaattttgtatggataaggcaatgcagtgcagtgtttcaacccactgatgttgaacatactgaccaggattttggctctgccacttgccagatttgtagctttagaaaaattacttacactcttcagggcttagatttttgaactagtctggtactcagttgagatttgctattctgtattgtttcttttctgtctgtaatgctttgttctcattcctgcatactgaaactcttcctgcaggtttttctctctggcagccatccccagttttagctgtggaaactcaagtaggcctctaacaaaatgttctgtggtggtgagaaagctaaggaaaaccagctgctaaaattacagcaagtctctggttgctgttgcttggtttctttccctgtatagttatttcccgtgcatggttcctcaaagtgaaatgaaccttagtgtcatatcacataatcatggaatgttagaactggcaggaaccagagatgattccatttctgtggtctgccagttcaaatccttgctgtgtagaaagcaagtccttgaccaaaggcctgccttgccaatcagcctccttgctattaatatattgtccctctgactcctttaacttgtttaattgcgctaagttcttaagtggatttactgccattccttatccagatctgaggctgtatgatataaagataactagtgtttgtttagtatttatgccattttagtagttatattttattcttaaaaagtaaaagtgactggttcaggaaataagtactctcaggattgagacatatttttacatgtttcattattttgataaattttaaaattagattttgtattaagaagactgttcagaaattatccccattatctcatttttattcattattcaaagaaatgtaagaaaataataagccctttatctagctattggaattttggaacttccgaggcaactgtgaatctcaagttagccagagaaaagggggcacagagtctttaagcaagaggagaaaactgtctcacaaccatagtttttttttttttttttttttttttcccttggaaaggaatagagctagccagaggacttagggtctagtttccataccaggtgggagggttagagacagcaagtgaaattggtggagaactttggaagttgtcaaatcttcattgagtgagaaaaataaagccgggacagaagtaccccaaggaagaccacagaaggaaatcctaacagaacatacatagctcaggagaccagaatcttttaggtcaaaagcaacaacctcaagagaacttaagaaaaccaagtgcattcttaaaccagaaaagtacactcagaaatcacggagaactcaagcaaaggactttcaggcaccaacctctcttacaagctctattatagcaccagtgaaataattgatattcatgaagatcatacaattttagactctttgggttggttgtagcttagagattatctagttcagggctgctcaaggtgtttcctgcacatcagtgccgtccaagagctgtttgttactaatccataaggatataaatatggaaactgagagtaagcatttaagcacttttgtagtaattccatgtgtgggaacacacaggtgagggagagtggactggtctcattcaagagggtgtcaaacagttcagcattttaaaacttacttggtgagtcatatgtggcatgagctggtagttcttcacagtagggcatgtattgatctgaaaggatggaaaaatctaaaaaacaaaataaaacaaaattggctgtttactaaaaagatcttgtgaagccccaatctagtgaaaaagcctacttttacatatgaaaagatagatgatttatccaagaaaatataaaaagatgatggcagaacccagaatatgggattaataacattttattaattaagcaaattatgcccaacatactctgcttcttaaaataggcaaagcatgcaacacattgtagaattaaaaaaaaaaaaagacaaacatttgagacctgtgggctcttaaaggttgaatcattcctccatggacttcacatttcaaataagattttgctatatatacacatacaactgtatcaccccacagaaaacatattttgcacttgaagtttgttgatctcttggggcattattttgtttctgggaattcttaaagaatataaggctatgctggatggcaattttctgggtcaattgtgcccaaggcactccctacagcaaattaggtaatgaaacaactcttgtgggcccttatgatgcaatttagggcactatagtggtaatagactagctgggggctcagcagctagtggaactctagggacctcaaagcatgactaagccttcttcagtgcccagttttctgccgtgggatggtgttaggcccgggaagaacagagcctaaatgcacccctctacccacttccaccgggatcttgacgaaggtagggatgctcctcgtatttccatggttagattaggctaattgtcccttacaagttgaggttttgaaacaactggaagtggatagaatcacaatggtcatattaccatgataataacaatatcttacatgtataccattgaacttttatctcattaggtcctcactatagtctcactataggccaagcagctacttttagctgctttgtaataagtaagccaaataaaggctcaaagattgaacagatttattgattttacccctcagttaaaactaagatccagggccgggcgcggtggctcacgcctataatcccagcactttgggaggccgaggtgggtggatcacgagttcaggagatcgaaaccatcctagctaacacggtgaaaccccatctctactgaaaatacaaaaaaaaaaaaaaaaattagtctgttgtggtggcgggtgcctgtagtcccagctacttgggaggctgaggcaggagaatggcgtgaacccgggaggtggagcttgcagtgagctgagatcgcaccactgcacttcagcctgggcgacagtgtgagactccatctcaaaaacaacaacaacaacaataaccaaaaaaactaagatccaggatgggtacagtggctcaggcctgtgatcccagcactttgggaggccaaagtgggaggattgcttgaggccaggagtttaggaccagcctggacaacatggtgagacacagtctctacccccaaaaaaaacaaaacaattagttggatgtgggcatagtggcatatgcctgtagtcctaactactcaggagactgaggtgggagactaaggcaggaggatcactggagaccaggagtttaaggctgaagtaagctatgattaaatcactatactccagcctgggtgacaaagcaagatcatctccaaacaaaacaaaacaaatcaacaaaaccctcagattcatccccatgtctccatctctactgtcactatccaagtccgtgccgccatcactcatcacctgcataactgcagaagcctaccaatagtctccctgactcactcagctcctccagtggattatttacatagcagccagagtgatctttttaaagtataaatcataccctgtctctctaagcttaaaaccctttaatggtttccatttttcttaggataaagtccaaacttcttggcaaggtttgcaaagcccagcaggtagcacttggccacctctgcaacttcctcttacactgctctcttgttactcttggtgcatttgccccattagccttcaaattcatcaagctcttttctgctctccctcccctcccaaaggctaactcgtactcatttgcaggtttccgtttaaaccctgcttcttcaagagcttccttaattcttcatctaaattagctccttctactttctctttcctcttattccaccctgatcttgtctccacggagtttttagcacgattcaaagttacgtccatctgtaggcttttctttgtttgagggccgtctccctcactacaatgcaagattgatgaggacaagccctatgcagctttgttcaccagtgaatattcacacatagctctctgcttcagagttctcttgctataaatatgtgataaataaaaaatgagggaatgataggcccaagagggcacagatgggcaagggtgatgtgagataatgcactctgcttctgaaataattcctaattacctttggttttgttcttaaaacacaactggagttcttagaagaaatatgcaatctggcatatagtaagggctcaataaatgtttgaatacatgaattaatatgtaatgaaagaatgaatgccatcgttacaaattagctgagttctccatgtgtttgtaatattaggatattactgtccccaagttgcattatcgacttcctggctttcagtgggcccagtgtccccacatgcctgctcaccccccactgcactaacctaaataatctctgattattttctttttctcttgctactaccaaattctgttctgagtgaggaagcagcttggttaaaaaacaaaagccctgatatgtatatatattttttttcctgaagaataccatcaggatgaaggctatgattaatacacataattgctacaaatggcagctaactgcagaaaaccacctcccagctgttggaggaaggaaattgctgacagccactccccattgggtggctaccaaaagagaggagctcacaggagcaggagagaatacacatctccatcccacgtgacccatagagatgacccatagggctctgtcttacatgtgagctttgccataaaatggtagtgttaagagtttttagggctggggtttacagccaggctttccatggctggggctggttttataggacatgctgtcctgcagaatgaacatttagaatccctgtggcccagttggtattactgcaaaacccaggttgaatcccttcaggaggagacagatgattcttggctggtcagatttcttctctcatcctttccttgttcatttgccctattctaatgggatggggaatgcacaaacaaggaagaagctctgggttgcttcttggagtctgctttgtgacctgagctcgacccttcactttcctgggcctcagtctcttcagtctataatgtgaggtgttagactagaagatcactgtttccttaattttaagcatctgtgttacaaaacatacgtacaaagtatgtgtacatatcatattaaaatgtatataaagttatatctatatctgtctatctatcatctattctctagtttctattagcttggtgcaaaagtaattgcggtttttgccattgaaagtaatggcaaaaaccgcaattacttttgcaccaactttgtatcaattatcacctatttatctttcaacgattattcatcatctatccatccacctatctatctatttatcaatcaatcattcttatgtatctccatacccccatcttctctgtctactgttttacagttagcacccgaaaagttatttgtacttgtgttagtgttaacatgtgtctggcttaactagtcccttgttcaggtgcaggaatttatcaacatataaatcagaagacaaaaaacttcaagcctaacacacttaatgcacataagcttctccaggccaccacttacagagttgtgctatacctttttttttttttttgatgtggcaaaaacaaaacaactcagcagctaaacagatgaaaagccaagctgtgggctaaggtatgtatttgatgaagctctctcttctctagatctttagtgggaagagttttgccacttgacacatatttaccccgcaaacctacactggcaatgctaaggcagtgagcacagaacacaggcctgaagtgtgctggaagttagctgaagggcaatgtcagcgcaccagctttgaaattacatgcagcgcagtcaccgtccctctggaaaactgtgcattctgtgaatgctgactctggaagtgcacacgctgagcatcagggctggaaaacagctgagagagaatgttctcccaggagaacaaaccttagcgagcttcctccatgtgttctgtacatctgcatcatctcatttcatcttcaaacaatccatgaagtaatgcagtcttctttatatggtaggaaaactgaggatcagaaaaattaactgattttattcaaggataccctgttagttgcagccactggtggtaacattttttagtgctttggtgccaaaaaagaaaaaaagaaatttttgtgctccaaataaaagaggacttctgtagaaattaaaataaggcattattagaactttaggaattttgcttctttctttgtcctctgattattcctgtgactttatgtatgaccccttaatgcaatggctgtgttctaccagttgatttggacatgtacatagttgaccttcaaacccattactgttgcatccgagactatccccttgaggagttccatcagggagggaggagcatcgtctagaagtcagaagtctttgcctgctgttagtattctccacagagctcctcctctccctcagttgagggtcacaggatgttagagaaatcaaaagccactggacatcagggaaagattgaggagcctgttacctgtcaccttttcatttagacggccttgcttctaaaattatattctgaattttccatttattcttgctgctatagactgaatgtttttccccctcccacacccactgttcatatgttgaagccctaatccccaatgtgatggtatttgaggtaggtagggaggtaattaggtttagatgaggacatggggatagagcccccttatgggataagaaaatgattataagaagagtgctcgatatggttaagctttgtgtcccacccgaatctcatcttgaattgagattcccataatccccataatccccatgtgtcaagggagagaccaggtggaggtaattgaatcatgggggttgctccctcatactgctcttgtgatagtgagtgagttctaatgagatctgatggttttataaggggctcttgccctctttgcttggcatttctccttcctggcgccttgcaaagagggtgccttgcttcctctttgccttccaccatgattgtaaatttcctgaggtttcccaagccatgctgaaatgtgagtcaattaaacctctttcctttataaattacccagcctcaggtagttctttacagcagtagaaaaatggactaatataatgcccttagaacaagaggaagagacaagagtcttccctttttctcggccatgtgaggacacaggaagaagatggccatctacaaatcagaaagagggcactcaccaggcaccgaatctgccagcactttgatcttggacttcctagcctccagaactgtgcaaaataaatgttggctgcttaagtcacccagtctatggtattttgttacagcagcccaaactggctaagatactgtcttgtaggtgaaacagggctaggagttattttacaggcataaagttacctgtttttacactcttgagaatcaattagtgggttggtatactaatggtagggtctaaaaaaagaagaaaaacaccaaatgcatttgaagcgattccaactttgggacactttttattatttcagacaaatgcagatagaatgtttactgaggtgtctccctggccctttatgtaatatttggatagcgcaatccttagctgcatgcagataatgtgttaggcagctagaaaaataacctgcttgtactgtttctgatttattccccctcctccctcacgtctttgttcacagtaaacacatcactgcagagtagctagcaaatgaatgcctttttatcagaggtacatgcccagttggtggctacgaccacatagaacagcagatatggccaaagggggaatcactgacaaaacaggcagaccctcacccagagtggatggtgtttcttggcatctgagaatcagaatatagaggaagatgaaagcactgtcgtgtttacggtgctggaaattatattgaaactcaagtaaaataatgatgctgctgctgctgatgatgatttgttgagtgtttactataggctctgatctggcatgctttccatgtataatttcatttatactttactacaacctcaggtgagagctacagttattatattattatacctattttataggtgaggaaaccgagacatagagagtttaaataacttgcccagtgtcacataggttaagaaccaggatcaagataagagctttcctcaactacccaggaaggaccaaacaagttaagagtctccagaatttgagaggaggaattatgattctggaagttccaatctttctctccagcttcagaaggatcaaccaatattttaaaggaatgtttaatccttgtggtatgagctgttggggtaagaaagaatatgggctggggtgaagattgaatatgagccaagttcagtctcattacaggactaggaagacagagaaataccaagatctagagcattgagggatattttgatgaagctctgttggctcttgcatggtccacatgaatgcaaagcattcattttttttctagatgagaggcacaaagaaataagacagcatttttcttttttcagtaaaatccctttagttttgactgcactaattctgtattttcctaatttagtcatgttaagctaaaatttacctttataccatgtaggttgagaggaggatttataaaacaaaaagagaaagtggtcagcctattctatcggatcaaatcagtaaattactaccaatcttcactacttcaggacaattattttattcaaataacaaatacactaattacaaatgaatgtccatttttaaatcacttgcaagagtcccacacacatttaacagagtggttttcttttctttaccttatgttcttggagataataaatcaacatttccctcagaaagcatttgttaattttttattcaatcataccaatcttttgcccaattaggaggcattagtgtaattttttcccattaaattgtacataagtactgtcgtccttgtttgaataattaactttcacctagatgccctatgtgtttcggttgatgtatttgctcacttgcatctgcggtttgctgtagctttgaaactactgacactttcaagcaagatggactaatgtctctgaaatgaagctggacatttggatttgtgacagtgagcttgacacttattaccttactaataggtagtaagcatataccaaaatgatttacatagagggtattagtacctattagtaccttactacctattagtaaggtaatatgtgtcaaagatttacatagagggtatatgcttactacctgttagtgctaagacattggttctgtcagatgaggattttctgattggcaactaaggaagttatgttcataatttaaagtgaaggggtgggatgggatagagctggatcaatgccccatggtactacagagtgagtgataacttggagaatattgtccccctgctccccacccagctgccagtttgactagcctttcaaatagcattcacttgtcctcaattctcacccaagacaaaacacccatgacttggaacaataaagcaaacatatttccaaaatggccatggcagaacagtgaaaaggtactttggtatatctcatgccacatttcacagatcttctgttctgtgatggtttatggaagtgaagtactttattatgtaaaattcatcctgttttttgtttgtttgtttgtttgttttgttttgtgatactacagatccatttcactatagccaaaggacatgcgtttggggtctggggatccatcagaggattcttctctcttcttctggtcccacaaagcaatcgtgagctttagaaaggaatcctaggaaaagtgaatagtcttccactgacatctgctctttcttatagcttacaatgaatactgcctcttaaagtgtcttcttaaagtggcacaaagagagcacctctgtgagtgcagggtgattgggcacgcagtaggagaagcactcagggttagcaagtgattttcctgacacaaaaccatttgttggcaagatctgtgggagaaacattctggattttgtatttcttgacctttccgtgctttcatttggtaaactttgcaaagcagaagctttatcttaaaagttgttgtggttttgtattaagctcttttgaagtaactgatatgacttattttgctttaagacttaaagtgcaatttttaataagctggtaccatttattaattacttactaatgatcccagcacagtgctttctgtatattatgtctcttcgtctctacaaaaaaccccaggacttataaattattatttttctctaatttgcggatggctaaactgaagcttaaagagattaagtaatttgctgaaaatcacatgacttctaaggaaggttgagattctttctgactccaaagcctgagcattatttcatcactgccttcctttatacattatgtatgttaattcaatgttttcctccctctcaggctacagaactcagatttcatgagagtttagagttctagtctccagagtttttcagtaacccttctctcttttcagtagaaagggagagttgttttaaaaatggataactacttaagaaaggcctttgacaatctctaacgtgtgaaaaattctttttggccactggcttctgatgactcaaattgtcagttgacttgtttgctaacatgttttagcttccatcactcccttccacagatggcatgaagaattggccatagtagataaccatgctacagtagatgccattcatttattgccattcatttatagcaaatagccattctatagcagatgccattcatttattttattttatttttattttttgagacagagcctcactcagttgcccaggctggagtgcagtggcgtgatctcggcttactgcaacctccgcctcccaggttcaagctattctcctgcctcagcctcccaagtagctggtatttataggcacacaccaccacgcctggctaatttttgtatgtttagtagagacggggtttcaccatgttggtcaggctggtctaaaactcctgacctcaggtgatccgcccaccttggcctcccaaaatgttgggattacagtcatgcgtgagccatggcacccgggctgatgccattcatttagagtagtcattctttcatagtagacagccattctgtagtagataccattttctatagtagcactaccccttaccatccgactagaagaagaataagtaagtgattagaaataaggctcctggttatagggtttgttacccaatgaacatgatgacttgattagcgtgccctttcagcccaatgtaggattttctatggactatgattgagagcagacacctacagatttgtttgctttacatatatagctgaatagtcaaaatgctatatccacctcaaatggagtcaggataagcattatgaaaagtcagaattggcagttgctaggtgatgtaatttgagggacttcatggagcataccctccaaaaaactcttactgatgcctgaaatttcacagttatgtcttgattacattggattgagcaacagcccctcctttaaaaaatgcaaattcttctcacacagggaggtagctattatgcccctgacacactgggtgcttattaagcactcgaagcagaacagaggatgtggatggatgaggagatggaaaaagttgtgcagtgaacagtttccctgagagctggcatggcaagaggggggcggtatgcccactgcacaggggcggggccaggtgctggatcctgcacagtgggaacatgctcccctctgccatcttttgttgggaagaggctcacacagcctttccagaagagaattgcaggaccaagcaaggtgaactgggaaagagaaggatctggaagtctaggatggcaagatagattggagagcaatacacagacaacctggggaagagacctcgcctgggtctgaggtgatggggtgggagccctggctctgcatctggctagctttgtaacccagtcccacgtctactgaccccttgacttcctgttcctttgtgtgtgtgtgtgtgtgtgtgtttgtttgtttgtttgtttgtttgttttgagaaggagtctcgctgtgtcacccaggctggagtgcagtggtgcgatcttggttcactgcaacctccgcctcccaggttcaagcgattctcttgcctcagcctcctgagtagctgggactacaggcgtgtgccaccatgcccggctaatttttgtatttttagtagagacggggtttcaccttattggtcaggctggtcttgaactcctgacctcaagatccacccgccttggcctcccaaagtgttgggattacaggcgtgagccaccgcacctggtccctgttccttatctttaaaatgagggcatttgactagggacatctccaagtttccttctagttatgaagaatacatttttttaaaattgtactggaatcttatgagaaacacgagggattattctttttgcttttaagatttatccatgatagagtataagataagccatgggacttgcttctctcccaactcaccatacccaaaagatattaatcttggtaagatcccacaaccaacactatgcttttgcaagagcatccaaagttgtgattttgggttttgttttgatttcttttgttggttttttaatttagcttgtgactaatagaaaaccagaaatactaatctcttacatcaaaggaaggttactggcaacctccttgtactctccagggaggcatggttctcttggacttagcctgggttgtctgcatctgggaaggacttggacaggaaagagctaggcataggagctgaaagggaaccttcttatcttcagactgggaggacacaggttatatcctccatcagaggtgtagaagaaatgatgctcaacaatcagtcacatcctcagaacttccccaggcttgcatccctggaaagctgaagtagtctttggggcttcagagaaggcatcaattgatggatctcagtccatgtgtgtgtgaggctcaaggttacctggcaaggcagtacagggcagtagtaaagagtgagtaaaggatttggggtcagcaaaacctggttttgatcctcgatgctacctctttcaatggacaggttaccaagcctcaactcccatgtctgtagaagagactgtcacaacacttgtctctgagttgtgacggctccacacaatagtccaggcaaggaggtaagcctggtgctcagcattgaccagccatctagaattggtcattgccattattattaaacagtgcagccctatggccagtgaaaaacaacttttaaggcagcaaggcacttgcagcatccaatctggggaaccactcagaaccccggaaaggtactccagcaacacctgacccttctcagattcacttccctttacatagcttgttacgtggtgagctttaactacagtgcgcagctctcatctcttcaagggtgggaggattgcactgcaaatatgtctaaaaaggcacctgtgtcaatatagtttgtgtcatattcaacagggagagcaaaatgaaatgcatctttcacagatctgtagaaaacaatcatcatgggtgcttcctaaactccatccagagagttaaaggcatcaatcgttattattttttcccttcaaaatacatataaagaatttaaaaatacatataatttttgacttcaggaatgtatgtttgtttacaagtaattttattgcaaaatatcaagaatgttctgacctctatgtgaatggatgtacatatatctccccaaagtggtctatgtcaatgtcagataaaaagtcattcatgtatttcagatgagatggaagaggaaagcaatttgccaagtagtgatgacataaaggaatgtgcttatagggtcttcagagggctatccctgcctggagggtttttgagggtaggtaggaggccaggtggttggctcctctgttattgaaaaaaggagattgtctttcagagagcactgaggcctagagcactcttatcacttggaatgcccgtcagggctcacagagagtggagaagcattttatatatcacaagccattgcatgccataacttctccttcttttcttgtcctctttattttcccctaccagcatggctctcagatttattaacagccctttcatgccttctacagccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgttgcagtggaaagaaaaaaagagctcaatgagtagaaaaggcaacttacatgaaatgagcagcttggctatgtgagcactaagcagtgcattacttacccagagcccttttccagaggcaggtgctgcccagtgccagctccagtgactctgggacgttgatggaaatgtgaatctggatgaggcacacatgcaggaggcttggagtaaggactcaactgggaattaggaatctaacatcctggaaatcaaagttgtcccctgttaatatatctgcttcatggttattttacaactaatgaacttatataaaaatcagaaagcctaggttctggtcttgggtatattgctaattactttgggaaagcatgaaactatactagccttgtaaaaagaagtagaaaatgtgtggtttttaaagcacttttcatagataatatctagaattcatcttcctgatatcatttgcaaagtagaagtgaggagcataccccttcttggacatggctatgaaaaccagttaattcctttttatgtaagtaccttgaggtaaacccaaagtcaaagcccttggaactcatccaaatagcctatgcaaaaattcatgatggagtgctgcagagcttttaaagaaatggtggtcatcttctggaatgggaaaaagaatagttgatatggataataccatagcattgcagagttctttttttttttttttttaagagaccaaatcttacgctgtcactcaggctggagtgcagtagtgtgatcatgactcactgcagcctcgaactcctgggctcaaacaacactcctgcctcagcctcccaagtagctgggactatagacacatgccaccgtgcccagataatctttttattttttgtagagatagggtctctttgttgcccaggctggtctggaactcctggcttcaagtgatccttctgagtcaccaggatttcaggcataagccaatatggctcagcaaattcttcatgttttcaaaacaatttttttatacttcacaataacctgatttaaggatacttcctaccataatgtacctgaaaaatatgacatgctaaaatgtgacagaactcctgttttcactgtcaacctggcacatgacaagtgttctcaataaaggtttgctgaatgaatgaataaaattattgagtgagtgggtaacttaaagccttcaagtaacacacagttaactatgtttatttggctctccctggccaaccccagtaatggttgggtacaaagaggaattggggtagataatgttggccataaaggatatgtaatctggttatattggtagttctgctgtcttgccatagaaaagggagccaaagggttttaactagagctctgtcaccttgggagaaccctcgggaaagaaccactgtccaggctagcagccacagaagccctagaagatcacacagtgaattgcttagcttctgctctcactgcagtgccttttacccaaaacaaactcttgttttggtaggagaaacaagaaggttggagttatacccaattctagcttcattctaaattcccttgtcaattattattctaattggatgaccctggacccctaaatctcagctcccctccttgaaaactgtcaataataatacctaaataggttgttgtgaagattctatgaaacattaatacaaagccagagctaaagccctgatacacaataagcttcaaaaatggtagctggcatcatcactatcatcacccccatttcaagggctctgggagtttcctggtatgaaacagtgataatgatgcttactgtttaaggttatagaattgaggagactatttgtaaagggcctcttgcgatgacaggcacgtaatagagaaaaaataagtattggctcctttctctctcctttcttctatgatgtcttcttacttttctactttagccgaggtagtggtacatcattactctttcataaagtgacacaatgtcattgaggaatgctcaaaaggccccagcagatggatgctcatagctggttgaagcagagttaggagggtagcatggaggggaaggaggaatgagcagcactcgggaatgcaagacagatcttttctgccaaacctggatgcactggaggctgccatcctaaagcttttgtgaagtttctgcctgtttctggagttatccatgtaatccttgagagaacacttctgtttgcacaaatcattccatacaacgtaattagctacttataatacagaggacacttgtgatcccaaattcaaacaattgcaaaagcaaaagcagtttattcatggtggtgtacaatgataattgataatgagctagatgactgtgaggtgctatggaatctcaaagactcttctgaattctcaaagggagttcaccttattcataggatgactttaggttagcagaaaataatgactttaaaaagtattataccataacaatgaatacattacttatattgttcatgtaattactagttcttcaaaaaccaaaatgccaaatttacaatgattagaaattaatagctaacaaaaacatcacactaactcgatgccctttatttgccaatgattctagctaatggagagtttttacttgatgtgctttattttttaccttctgacatctgatccatgtagaatgaccagccttcctggttttctaggaaccagctattttagcactaaaagtcctagtgaacttctcatttctaggcaaattgggatggctggttattctacttgaagcacctggtggacctcttttcaggacagcaccatgtttagactaacatctgactgacaactcaaaacgaaaagaatctctggttccagattatttataacttttggatcttgttgatgaagaaaatttttatgaaaaaagaaaatagagttgactacttttctatttatttaaataataacattaacaaattttgtctatccttgccatcattttataagacaggaaattacaaaaccaaaaaagtagaaaggagtagaatgtaaattttacaagggttccagagtgatgtgtttatcactatgttcccagtgcctagcagtgtgtggtgtggcatagatcctacataaatatttgttgaataaatgcacagtgcataaatttagcttttactacaaatgtactacactcttcttatttttctttctttctttcttttttttttttttttgttgtttttgagacggagtctcattctgtcacccaggctggagtgcagtggcgcgatcttggctcacggcaagctccgcctcctgggttcacgccattctcctgcctcatcttccagagtagctgggactgcaggtgcctgccacaacacccagctactttttctgtatttttagtagagacggggtttcaccgtgttagccaggatggtctcgatctcctgacctcgtggtccgcccacctcggcctcccaaagtgctgggattacagacgtgagccgctgcacccggccatttttctaaatgtattatagattgatgaaaactttcccttagaccattgcttggggatcaatagttgaaatctaagtctgtggactgtagagttttttgatagtaagtttttattgtaaattattttaatggcattctgttgtttatcctagtctcatgttcattatagttggtgtggtcaacctcccatgagataatcattcagataagaccaagtttccgggcctgtaaatcagagaatcaggttcatttaacatcctcttagatctcaacttctatcagtagcaagatacatctttgcagatacctacatggagatttcactacatctggcagggatgagccaccggtcctcattttcttaattcctggacaaggtttttgtgtattctaaccaagtattcttgcttttctttgttctgattcattcatctacaaagtgtggtcagaaaccttgaccaactgctgatatatacaaatatcacaacttctctaagtctgggatctcctaccacagttgagatatccaaatcattcacagttttgtcataactcgtggattaaaaaaatcattgataaatcatatccggtatttctgaagaggtttagaattttggtttcatggatagcataggaaatgtaaattatccatcacaaatgtctttacaagttacaaaactaaaccaatttgagtgttcatttcagagaggcttaatactctcagttttgttgtttcttttaatcacaaatcaactaaccatttccctttctgcagctaccttgcacaatccctgagcatatttctgaccttagccctctggtgtcatagctctgattctagctgtttggctttggatggggttgttggggtgttgcagcatctgtaaatggttaaaggagcattagactcaatgtatcaggctcatgcctgtaatcccagcactttggaggctgaggcggcaggatcaggaggatcaggaggatcaggtcaggagatcaagaccatcctggctaatttggtgaaaccccgtctctgctaaaaaaaaaaaatacaaaaaattagccgggcgtggtggcggctgcctgtagtcccaccttctcaggcggctgaggcaggagaatggtgtgaacccaggaggcggagcttgcagtgagccgagatcgcgccactgcactccagcctgggcgacagagcgagactccgtctcaaaaaaaaaaaaaaaaaaagtggatttccttatttatgctctcataattaagataattttagcatttatatcgtgtagtgaatatacacaattcccatgatttttttcctattgttttatgatccgtatttatatcccaaagtatatggttaatacctctaagtttttgctgaaaatctagccttgttgagcagatacaggttcctttagcagctggtgaagggtgcttatactttaaaaaatcagataatgtatgtgaaagtggtttggaatatgtgacatgctatgcaaacgtgtatttttttttttaaagaaatgaatagctcgtctcccacaggcatattattgacaggggtctttgcaaaagatacacaaacctaaataggaagcagcatgatctaatggaaagcatatagtctttggaggttaacattggcttgtattttggatctgctttcaactggaaatattagaaggatttagtcccttctgagccttagttttatcatttgaaaaatgggctagtaaaactttatttcacagggcttttgtgagggataaataagaaatatacaaagtatcctaataaaaagttctcatttcagatgaaatatgagcatgtagatatgctatctctattaataattcatttgttctgtgttgttttgaactcttgtaactttaaatcactaaaacaggttaattcttgtcaaatgctatttacatcgtgtttgtttcattgaagcataatacaggttcaataaatgttaatttcctgttctttgtatgctatagcaaaaataaaaaatcttctgatgcttaaaaagactggtaatagtcggctgggcgtagtggctcacgcatgtaatcccagcactttgggaggccgagacgggcagatcatgaggtcaggagattgagaccatcctggctaacacggtgaaaccccatctctactaaaaatataaaaaaataaaaaattaaaaaaaaaattagcctggtgtggtggcgggtgcctgtagtcctagctactcgggaggctgaggcaggagaatggcatgaacccgggaggcagagcttgcagtgagccaagatcgcgccactgcactcagcctgggctacagagcgagactctgtcaaaaaaaaaaaaaaaaagagactggtaatagcctgagatgaagaaatgacaaaaatgaaataaatactttcttctagttttatgcaccatattagtactataattgaatatgcaatcactaaagattttcttctttatttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcacagcgtatggttaaaaagttgacatccataaatcaaataaccaaagaatcattcaagatttattgggcggttagacgttttattggcagcagagatttaacttttcaaaaaatgatgaagtatttcaaacataaaacatgtagaacctatagtagaggatattgcaaacattgctttacccatcactcagattgaacaaatcttaatgttttgccatttttgctttatatctttttgtaaagacttagtcatgttcgaataccttcctggttccatttattctcttcctcctccaaagtaaccactacctgaagttgatggggagattttctgtatacatatttcttattcttgttacatacaaatagagctgtagtatcaaataattagtgatcactatatagctatgtgtatgtatgtgtatatatatataaattagtgggggtcaattttatcagcccctcatcatttatattcattattctctatatattctgggctgaaggaaggacatgttaagtaaaattctttaataccttatacttccctgttcatcacccaagcaaaacttggtaccacctctagatcccactttcctgttttaggatcagaaagcatttggctcctaaaatatctgtaggaagtttcacataatatctgattgtcttgttttctctagatacttaaaggtggggagttttaccaaaaatataatctaattgcagatttattaaggcaggaagtagattacattgtcttctaagatttcttctgatactatggtgataattgttacagagaattctttacttgttttcatcttgggctaaagagatatttgatagaaataaacattttaaagttcatatggtaaaaaattcatacttattgctttgaaatatctaaatatctgtatgagttttcccaaattctgtaaaccttcatgacttctatattattttctaaacatgtatgtgtgaatatagtgagtatctaattttggtagcaattagtgttgatatgtgtgctactgtatataaaaaacatttcagatgctctactttgggctctagattcattgtggatatttttcattattattaattttgtttgtatgaaaattatacaaaaatatacagtgttactagggacacagacctctcctctccagctctgtgtccctcctaacatttttgtccttatgaagtccacagaatgtagtgtgacagcatggcatttgctattccagtataatcgccttagttattgagtacttttgatgattctttttggtcttggccaagggtgaaaggatatgtaagtttgtgagtatgtatatattgtacaattttttttgttcaaaaacttcaaaattctatgtgaaacttatttataggaagtcaattctggttaagttctccaccatcctaattacttatatactctgtgtaacttcaggaaatgtatttttaggaaacactgtaggctagagctggctttgacattattgatatattttcttgtcattgaactcatgtggctccagatgtgcctattatccctccagtcacagtgaaagcaacccaaggaccagtttgatatcctgaatttctcctgatacttttattttggtgcctatttcaatatttgttgagcgctgaggtgacaaccataacatttccctctgatttctgaactgattgtgtaatagacataagagtcaaatcataattgtgtcaaggatccaaatatcagttctattgctggtagagttagagcatgtggcttttactgcagtaaaattgggcttctttataatttttcctttgaattaaactcagctactcagcaacagttagaagagccagaaaactgcaggccttcttccataagggcagagtttactgtggtaaggattactgcatgggactgcctaaaggagaactcacaagccttgtagaaagaaatagagtaaaaggcaggtcacctgggaatagtgactatctaattacgaaatgtagaactagggtatcagacccttactacagcaccaagcagatgaatcactgcaggagaatgaataaaggagacatggtcaaagtgttactccaaaatgatctcttctggggaatggggaggaaatgttctcgtggagtcacgggggcaggaaaatggattcccctctgtaagacggagtgcactatttgtgttcaatgcttgtttgattgactgacccataattaaaatgagaaacgaatactgaaagaagcataattacagttttgcttatatggatctggtggttgacggaaagtaaaatatacagtacattacataaattattgtaagtgggaagacaggcatgtgcagtacaattggcccaggttgtgtatttctttttttattttttatttttttagcaatatccgtcctatcttagaaatgtctcctggatccctatattacataaattattataagtgggaagacaggcagtacaattgtgtgcagtacaattggcaaacaattggctcatgttctgtgtttttttttattttttattttttagcaatatccatcctatcttaggaatgtctcctggctccctcttcacctctctagccatttgtccacccactggacccctggtacaatacaagtataattgtgccactcattagctgaatttcttctctgctaattccccatccccagtgctcaagaatgtagagaaggccccagtctgcatcttgagcctatacatgtgtccattgctctagccaccttgcacttttcaccttctcctaaatactctgtgctcttctaatgaccacaccaatggatatgctgtttcttctaattagcatttcattcctccctttgtaggtaaactattcataactcaagacacattttaagtatgacctcctgtatggaaacttctcttatgcccagggtcagttattccctcttctgtgtgcctatatcacctaccaaacccttactacactggtaattatttgcttgtgcataccttctcaacaacaatgatagctaacacttctatggctgggaactgggccaagaactttattgtattcctgcctcacagcaactctatgaaatatgtactatggttattcccattttgtagattagggaaagaagggttagagaagttaagtaataagctagagttccatagatttagataagtttcagagctggctgccaaacccgcatctgtctgattgaaagcttttctcatcacagttcataatgtaagtccactgttcaaccaggcagagtgccctgttaacatgaatccgttgtcagggcctggcacatagcaggcattcaaaattttttagctttacaatttcttttttttgtaaaatgtcagctaatgatttatacttacaaggttgccatgtgacttaagtgcattcagcactgaacacattacctggtgcatagtaggcacctgtgaatctttactttttaagtgaataaacaaaaatgtaacttttattgtaatgcagttgacagcaattcagtctttaggataccattagctttctagtgatttcagtgaagcgtggttttccaggccattcttctgtggacggaggcagcttccctcaccaggatgctggctgtttattttccaagtgacaagttgatttactattttccttctcatcactttcaagaagcatctgcaggctagtgagtgacccaggcagtgtggaaaagtctatttatttctctgctgcatctttcctacggagagtctgaggataagggttggaaatggcctcaggaggtcagatttcctgtgtattttcttttgtagtgcaggattgctcagggcgacacaatttcccgtctgctggtacactctgcttttaaaatacctgtgtgatgggatgtgtcaggtaaagaattttgttgtttgtccttgggggatggctctgcagcttgatctctcttaatgctttctttggccctaaaatacattgtaagggaaatgagacagggagagccaagagtgcagttcacttgtgcaatcttttgccttttaacacaatcattctgttcctccctaaattctagcaggaaatgtcattaagtgtacaatagaattcactccactaaaagaatttctactttcccctcacttttgcaaatatgatcatctcacagctcagcagataacttggatgtctgctcacagcttcctaagaggctcttagaggtaggtgttcctgttcagtatattggattcttagcaggttggatagtaaggaaacagacttgtagaggaacgaactcatacttgccttgttcttttgccagcaaaatactcaaattgctgttttagctcaatatacctttcagcactgagggtatatgcagcccctccatcccccaggaatgagtagaactgtgcaatcgtggacttattccctagacgtttctttctgcagttgtgtactcttttgccttggagccattacttcttttgtcattactgaggcttctttgcctggaaagcactggccagaattgggtgatctgtgagttcacgacttgagaacctccaacctctgattgcagttgcactggtggagaaggcacaatatagcccctgctgggtttgtcttcacagagagtaaatgagttcacaggctggccacaagaccacaggccatctctttgcctagcaggcaaggcaatagtagcccacgtgtttttgtgcctcattagtttccaggtgggccaggccaggatgggcagccaggttatctttgcatgaatacagactaaagtactgcactgtgctgctgtacgagaccaatttgaaggacaaaggctgcatgctacaatgagaacaatttcgctgtgtctctgaggctcatcatcaggaagctggctcccactcctttctggagctcagcaggtgttcttcacaggaccactggctacagccacttcagaggggtcagcattttaacgggctcttctaagtatctaaaaattccatttctaaggctctctgttggaggtaaagagtgttatcttctcagattggcttttttcagcttgttgttgagaatttggaaagaaagtcaacctactcccctacttgcctgctttgtttcctgctgcctaccagggctcttgtctaccattgtcagtagttttacctttcaacaggttgaacctcatgcagctgcagaatatcagatatagggtgctaggcatctgctttgggaatctgagttcctggcaaagtagtggtatggtgtagtaggaaaagcaatggaatgaaaatcatagcgttacagttttggaaatggcactccgtagtaccttgtatgacccctgtaaactctatgtgtctctatttcctcacattggtgtaatcatagtaaaatgacctcacagaacattgagaggatacaaataatgattaagaaggcatttggaaatccatgacacgtccagatgcatgtaaatacctgcttgcaaatggccctagaatccttctttatcaatgtctgacatgttttcattttcagtcctttcttgactaattctttgtctttttctgccaaattttgcctttggtctttggctttccaatgattgcatttggatcttaagtatccacactttggtttcctcctgtgttctctggcttgctgtgcctctgcctctcttaggttgttctgctaggaacttctgcttacattcttgcccagtgaagtgtaaacctcactatatccaggaactatatcaacatctaggctgaaccagttccaggcaacccctgaaaaagtagttcaaatgtatttctaaaagattatgcaatctcttaaaaatacaggttgaatccttctatccttctcagtaaaattatgcaatggttccccataacttatagaagttcaaattttttgcccttaaagcccagtttgggtttttaagacaccaagccattaggaatggcaggcctaattaaacagttgcatgcattttccccacacttcttagattgcatagtaataaaatataacactgagtattttaatctgctttggaatttctcagagaaatagagtgattattatataaattataagttgggtgtcttttagggggaaagaagtgaagaacagaattaagtaaatgcttattaatactaagtatatatcagtattgaattaatcagccatttgaaagatcagtacttcatatatcttatacaaactgatttaaaatcttgagttatacatatctagattgcatctagtgtttaatcaattggacacttacaaataatggataaatgatttgttgtcatacagagttgagctttgcttttcatgcagtgagaataatacttttcatttttacacttatgcagttgattgtaaactttgggatgatataatttaaatggatctaaacagtccattagctatgtcagtgcctcctctcttgccaagctatagttttatgctaagctgttgtgtactgtattacataatcccctgcattcattttctccacctatttagcttgaataaatacaaggtgactgcattgtctcttcaacctacttctcagtaaaaacaccaagtataaaaaacagatttttgggtgctattttgttttttctaatggaggattcaaaggattgaataaggttagaaatgcatgtttgtcactatttggttttgccccttttagttacccttactgtcaacttagtatggttttcaaggtgataagagagtggttgagtctcagctactggaaggaaattaagatagattggaggtcttagaagaaaaatcatgtcagttgtgcaagtggacaaaacaatgatttcttcaaggtcctcatttttttctccttctcctttctagcccttgatttgctcttttaaagactgggttattgggaggcagagcttgcagtgagtcgaggtcgtgccactgcactccagcctgggggacagagcgagactctgtctcaagaaaaaaagaaaaggactgggttatgcattgctagtgcctcttaccccataacatgtaggggaaaattattccatcacttgaaaatgatatacatttgcttatgtaggatacgattcagagagaagctttcagttgtctattgtttgttgaccaatggaggagatatcccaacatggtaatgctgatcttggtagcctcctctgactcagggaagaggtaaactgagaaaattcttcactggatgaaaagatggggaaggttgtgaatggttacagcaatttctgttaaatatttgcaaaggaaggcacttggccacataaaatcttcttcggtatagttgcatggagattagcataaatatgcatgtgatttgcataggccttttcttcctcacgttggttttagttcttatttatttatggtgatattctcttctctacactgatgccattttttcccctgtggcctcccacataaaagaagtgtttttgctttaaatacagatctaagggctgaaagggaaacatttcttttggtgaatgagtgattcatgtaaggtgagaggaattggtttctggctcaatttattcaaagtttgggatggtttgtcagtcaatgcacagttccatggaatcatctgtggcctttgacaagacaagtaggagcatctggaatatccagagtgatgggcaaagggaagataatgaatatttagactaagaaaagaccagacatgccccaagcccagagtaccacaaactaactgtgatgtctcaggcaactcacttatttctagtcatcaatttcttccttaataaaataagggcattaaatcaggccatctctaaaatcccttatagctctaaaatttattattttgacagactccttgctctaattatataaaaaatattaagcaccatgtagcacattaaataatatctggtgccttgctgttctgtcaaacttttcccctttgaagggtactggatgattaatttaagcttctctttataggcactactttccttgctcatttttctcagttcagtgggcacacaaggtataacttaaatgtttatagaagacacccattaatataccacttgcggtgccaaggacatgcacagtagttggctttgtggacatccatgtctgtagaaaaagagcttagttgtgataacgccatttgatttgtcaccttctactctagatcagggtcacctccaggtctcctgagcagggccttgtccaattgcattttaacaaagacgattcttcagaaatgaggggagagatcatgacaatagacagaacatttggggagtggatagaactacttcaaacacgcagacagtgttgaatttctgctttattatttttggggggctatttctgctaaaatccagtatgagttatgggctaactacttatacatgtgcaagctaccctgtgagcatttataggtgaacaggtctcttttgcttataccaatgtgtgtgcaagcagacatatgcaggtagatacatatgactgggctgctctggaacacacaagagaaacttgatctcttctttaactccctggagtatgaagctgaggctgatgttttaatgatgtcataatgctaagattaatttaacaatatgtagtgggtagaagtcttttcacattataaaatatctcctttttacagctcttactttatgatgaaaaaatattcattttgcctaagaaatttacctggggctgtaatggttaacacagatctgagttgaagtggacttggctttggttaattagcctggagtgtagttccggcagggaaaatataattctctcaaccttattttgtagcctccaatctttagagggaaactgtatacctcaactattgttgccattttcttttagtaatgaggtgcttttgatagcttttgaccaactctggtatgaagtagaccattctaagtaaggctatctggcaagaagacaaatggaaggtcataacactgtgtgtcaaaattatagatcgaatcaacaaataattaaataaaatatatttcaccctcttaccttgacaaatatacctttaaaactagttggaaagccaggctcaaatttagagtttttggattccttggagttctgcattgggaaatagcagcacaaggggaaccagccaacccctagtcctcaacccatggtctactcccttctcttcccacctttggctttgtcctatatcatgaagggtctggtatgaatgcatgtggttgccccagcctaatggagaagccttatccacatctctgcaaatagtctcccacggctactcctcagaccttgcaatatgtatggtttgcctttagaaagatggatcaagggctgggtgcagtggctcacgcctgtaatcctaacactttgggaggccaaggcaggcagatcacaaagtcaagagattgagaccatcctggccaacatggtgaaaccctgtctctactaaaaatacaaaagttagtcgggcgtgttgtcacacacctgtagtcccagctacttgggaggctgaggcaggagaatcgcttgaacccgggaggcggaggttgcagtgagccgagatcacaccactgcactccagcctggtgacagagcaagactcagaaaaaaaaaaaaaaaaaaggaaataaaaagaagaagaagaaaaaagaaagatggatccagggaagaggcctgcacaagccctgaaaaacaggcttaaggctttttgggtgggcaattacagggtcccagtctatgaaatattgtcttgaaagagtatatgggctccagtagaatgcgatcttggccccatggaactctagttctgtggggaaggatagttctgtggggaagaagagaatgccgtcctggccctgtggaactctagttctgtggccataggatagtccaaccagggtcttcaaaacaggataccctagagcagagagtcttgagtttaacagtggtattgctgtcttatcaaaacatatcaaattaattctcttcccctctccttacctgctgtatcacctgctcaggtccaacctcctacttaacaactcagccatgttccagggggcttaggactgtattatagaaaccaaagttagctgagttattgacagatgaaaatcccagccagatctttcggggtaatttatttttagttattggtcaataaaagctacctggagctagagagtcctttgtcagaacagttaattatccattctaaaccagctcttctacaagcatttaaaagcaattcctgaagcaaaagcaactcgagcctcacttgatcattttgcatgaaacctccctttaggtttttcttgagaaaattcgaaggaaaggcagcaatctcttttgcaccatcttgttttgtcttctaccctcgtgtggacacgtcgtttctctgcagtcacccctgctgctagtttccctggtgtttcgatataggacttgcagaagaattgaagggagtgctgtgttggtatcagcacaagaacggggcagtgcccctgcggtgtgttctctttggtatttgcataggtctgactcttgccagacaagtgctgattgctttcctcttttcttttcctatagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtaatggctgaggggagagaattcctggaaggctcatcttaggtggctgggtagtaaatttgtgaagcaggtgatgggtgtgaggtggagaggggtggagattcagggatggagatgttaacgtctaactttctcccagtctttgcaatttcacgtggaaaattattaaaatatgtttctccacatacttcaattctctctctgtgcttgttatttaagaaaaaaaaaaacaactcagttgtatagataataaaagttgtaagtactttcattccttttattctgctttcctttgatcattttcttaattacatttgaatcttatcgtattattgttaaattcaattagggactgcattttgtttctgcagcttcgtagattttcctcattctttgaatatatgtttttctttttaattaagttagccattgccacgatgccataattttaattccttccagaaaaagtcttccttttcctcttttaatttactaccctttcccaactatttttttcttttatgttaacctctagctttggaattaattagccgggatctttctgaattcctctgtttctctgttcttgatgcggtggtcctactctattgcccctgtctctccctccgagactcttcagttgactgggaggcctggaaagtggaaggacccaaataaaaaagtcaactttggagcagcctttcctggttctgtccgtgcttgggaactcccatcgcttgccgattctaagcaggcacctccgtcaggtgacaacattctcagaaagccttagccaagtgaagttgttttcaatttcatgactaataataatgataacaataataatacctcatcagctcacatcagtaaaagaaaaccgtttcctataaaaatcaaagtctgtgctgagaccgccttttccaggttgccattttcacttggtttttctatttgcgaatctgttgttaaacccagttggatggcatccaggctttattaaccagaaaacactatactttctgaagtgcttatcaaaaagtgcttaccaaattttcttctgccacatgattgatttaatgtcttctaatgtcaatgtgaaagcgtaagaaatgataggtgtctgcctacgttttctgtttgataaaagtgtaactccttacgaatactaaacaaatggtataggctggcacacatttgaaacacatttccacacttaggtatgtcaaggaagccatcctgttgggagattacatttatctcaggtaaaaatgccaaatgacacaagacttagagtccccaagcatcttgacattcatgaatctgatatttttgaatcattgttctatgtttttcctccaaggccaaagaaccctattgctaatatcttctttcgtcattcctcatccatacttacccaggagagaacgtctcaactgtcaagagaacccaaatcaaatatccatttgctaacacataagggcttgttacatgagagctgcagagactagacctaaaagtgaaatacaaccttttgctagttttgattggcaggtacaaaataacacgctttaggcattaatcagtggaggagagacttttcatgtacttcagagcacaatcaggtcatgattctcaccaatttgtttctctacctctctcccaccacccttccttaccattctggaatgattccaattctcctgtgaaaggctcacttttgtttctactaaaaacacttttctaaaatagtatcaggcacacttaagtcctttaaatggagagaggataaaccaaactgtaattcaaatattgtttgtgctgttttaatcagagcagctagaggaaaactaccctggatgtttttcccgcccctgcccttcatgttctaaggcccaactctgctctgtgcccttgggcaagccatttgacctttctccaccacagtctccatttgcaaaatggtggttacaatcttccgcagccatgtgtggtggctaaatatgcaaagcaccttatgttccagaaggattatgagctcatccatggtctaggtatagacgtgctgtgacgtgcacatgatctacaggctgagctttctgtttcaaaggtgactgcatctgtctggcaccaaggatgcagctaagtgcaattctctgttctagacagggatacagaggccctacagtattgggggtatttcttggcagagggagtattaatcttctgtgagaaagtgaacctaaaattgaacctcattgaaattctgactaaattttgcatccaaatgcaatttattgaaagaggaaaatctctgaaaagcaaagttgattttgcaaatgcaattattttaatgtgaataatataagattattattttgtccattaaaataatatttataacatctatttgagttccctgggatacatttgaatggtgggatcttcctgtctatttcaattaaactataaagagctccataaatatttgacaacaaacttatagcagccttattcatatttttggtaagattgaatggcttttatgacaaaaattcattgagtaaagtttacctggggtttcccggagtacttattaccaaatggagcagaagtctcctcatttcttccttcatgatcatctattcatggttttgcctttaagccaggtcaggaccaaggccaggtattttattgtggcttacaattaaaggaaggaatgtggactacctgtatctattgcaaactataactgggattagggaccaaggtagtgaggaatttgtgtgtttgtatgtggtagtggggtggtaattggtccttgacattgcctgagtccaaggtcatggccataactttcattgctttacctctatgtgttaacttttgttaaatcacaaacacaaaactgaggttaccagtcttccagtcttccagagggtttttctaatcatgtttaacctgccagtcttccctgctatccatacaataaattacataaaagcttgaaaagcattgttcaagaggaattgggggagagagattccaaagcattctggccaagtaaacaaattaatgaccttattgagtaataaagaagattctaattttttttgatacattctattaattctaaactgaaggaaaactgtttctctctggttgcacacatccacaaaaatgaaataggctgtagatgtttaattatctatggaaacctagagtacactacataaggcagactttctatgctaggtttgatctgtaaatgctttaagttttttcctttttgggaggatttcatgatcatttatccacattgtagtcatagtcagatgtgaaaaaagtaaaccccaaaatatttgtatttcagttctttgtatctgtttttctacatgtggaatggtacctgttggggggtctttccttttggaagaggtggaatgggtttgtgttagagggtgggaagggagtgggcggtgtccattcagaaagcccttaggaagtaagtatggtgctaattctaacgggtgaggtgtggtctgagagagatttggaagaagcagggagctgcaatggcatgtagactgcagctccttttctggctgtgccccaggtggcatggttttccatagagtcctggtctcattgtcttccccccactctctttttctgtgtcgggtgccttttttttgagaaactaacacaagatcattcatgcaatgtgtcattttactaaccgactaatgtactaacaccctaacgactcatctttgtttttagtttttttaattaacaatcgttctgttcacaatttttaatttcctttcttcccccttctccgcaaagcactcaggcatcggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgcacttgtcctaaaaatgatatttggttgaattttgtggggaaggtttccttttctctagttttcaattttttcccccaaaaaatgctttttttttttttttttaaatctctatttggctaaatttgttttcttttgttttcttattttacaacttccaagttacatactagggacaacagagatttatagtgagaacttccttctttctgtgccttcctctccctctcactcttcctcttttctttttttctcctttcccactccttagtcccttttctctttcccttttatatggccacggctgccacaggtgatctggggaggaaagtactccacttcctagactctttcttacccttcttttactttactcccctaccgtggccaaaaggatatccaccaattatgttctccatacaaactctgcatggcatgttcctgtctcgtgaattttcctacctgcatcagaatttgtttcctcattttcctcctcattactaacaacctaccaatcatcaacccaatttcagtttcttctcttttatttttccccactcttcattctcctttcatctttcatatatttgggggttgggtttggactttttcttttcttttcttttcttttatttagtaagggaggtggcaggcagagaaaagactaccttttagttttgaatgcttttttttcacttccatcttgttcttcggtttgttcaatgcatgtaagtgtgaagtggattttgattctttccctaatttctccccaccctttcccagttttgtttttcttctgccttctctcttggttccagataatttctgcatgggtgtatcggtgtatggtgtgtgcatgctttgaggccccatcgtttctctctgccctctgctcctttcatggatgttgggtaaaagggtgctatttcttttctgtgggcattattatttttattgttttggttattattcctcatcattcattttattgttgttcttagagttgcctttttggtttgggtcatttcttctcttggaggtggtgatgggagccaagggagggtagggattggtgtcctggggcagtccatggcatgtatcatccatgaccatatcagaatcaagacccttctccttccctccctgaatgcatgtttgtcagcgtggtgtgagccaaaaaatattaataacaataaagataaaagaaaagaaaaaagaaaagaaaagaaaaaaggaaaaataaaaccatcaacaaccaaagaccaacccctaacaaatttcatcatcaaatgtcttctttgctgtttttcactaccaccatgaataacaatcatgtaagaaataaacaatcattttagcaatgaactgagacaagtgatatcgtctgaggatggttccattttctagcctgactgtgtaaagattgcaatgggtagaacaaggtgcccagcttggaaattctaacaaagtcatccatgagtctgcagggaaatactgaaggcttgagacccagggaggcagaccagaaaatggaacttggctgcacataccaaaatcaaatcaaattagaaagtatatctcatgaaaatcttaatgaaagtgatgccacaagtaggggaagccactgggttatgataggatcgtaaggtcattgttgggattttttttgtccctatgtccctccaccaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggtaaagttcacccaattctatttaatgcaccatgtgattgtttcatttataaacaaatgacatgtctaaatcaatgactggatctgtcctcaaatctatgagatgatagattgcagcagaaacaaccttgaacttggaagtaggtgtcctacgttttcattcccgcttaagctggttgcatgacttggggtttgtcactttagtactgtattagtctgtttgcatgctgctgataaagacatacccaagactgggtaatttataaagaaaagaggtttaattgatttacagttccacatatctggggaggtctcacaatcatggcagaaggcaaggaggagcaagtcacatcttacatggtggcagggaagaaaaacttgtgcagaggaactcctctttaataaaaccatcagatcttatgagacttattcactatcatgagaacagcatgggaaagacctgaccccatgatttaattacctcccactggcttcctcccactggctccctcccacgacatgtgggaattgtgggagctacaattcaagatgaaatttgggtggggacacagccaaaccatgtcaagtaccctgtagttctatttcctcatctaacaaatggaagctcttatcccacagatggctgtgtttataaattaaatgcagtcacacaggtgaaaggccattgaaatcacaaggaactagatgagtgcaaagtttgattttgtgattttgacctggcaaataggaaagctctagctaaaagtggctcaatctgttgttgtgtaccctgtctaaaatataacatatgtattattttaccttcactaagcctggtgttcccaagggtctcatagttgagacggaagaaaattcttataatgtgacattaaggctcagaagactggttttttcctttgcttcttcttcttccctgagagctagtagctgtgaaaaaacagtgggactttgccactacttgtttattaccattgtagctgatgtattgagacctctttctgagagcaaaggagcttcagccaagtgtaagttcaacctctaaggtcaattgttgaggcaaaaagaatcagactaaatttggtagagctctttcagaacactgtggcatcaaagcagtgcactgcacattttaagctaagcttcattgccgaagatatctataccatctccctggggatgttacttgagaagcaaacagtgttccttcttgtagataacaatcccttgtgacatcttatgagtctcctcttggggcatatgttttattcttactatggttatttgaaatttgttgaacatcatttgtatatgagatggcactgtccatgcattcattcatgccactgccctgtgagccttgtccaggcaggaattgtgtctgttaggcatggcacatagtagatgcataataaggatttgtttgtctatttatctgataatcattgagtaccttttttgtgctgtaactaaatttggtggctctttttaagccatgatctccatgctccaaggctttgccttgtaggaagggagatgagatcagtgagtgaataagtatagcataggagtacatgtgttcagtggcacatactaaatgctctaattgagtagaggaaacataaattttaggtggaagtcagttttagagaaggagtgacatttgaggcagtccttgttgtaataaatcatgtgcgaattgagaggaaggggtagaaaagagagacataataaaggagagaaaatccaattgtagctttgtattgttctcagcctgtaggacaaaataagaggagcacccaaagagtgctattatctctctgcaggatgttacctaggcttctgctggcttcagagatttcatcgtcatttctgatggaattatggtaggcatagagcccttcctcactgggatttactcctatttggatagaataaaggtatagactatgcactgtctagtgaaccctgaaagactcttaaacactgttaaatcacactacattggaattgcactctcatcagaaaaagactgcaacattcttgttaccaaggacatggctcaggaatgaatgaggcattggttgctgtggagtgctcattcagttttgtagtgcaacagtcctgagcatggagtctctccaggacaggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagcttaaaaggtaaaggcagttctgaaaaacagtgtcaataatagaaataactataatcagtgatgtcaatatatccttatcttagctagcagcacaaatatgcatttaaattcagaccaagttagaaaaaggaaagttcaaaacactaacggaaatgataggcaaagctagaacttgataaactcctgccccgtctgttttccctgtacagcgtgatagtctttctaagggactcggaagtcttcttatttgtctgagtactttgaacagatcactttgagtctaacgtagtgctggcatattatttctttgcatttaataattacacttcacttttctgtgggcaggtctatggagatacttctcttgttcttggtatttgtttttgataaatcagtaaacagcaaaggctatgttaggattcagctacctgataaaccccactcacccacttaaaccatagaacagtctttaattatttcacaatctcttcttccccttccttttcctcttgctgccttaaaaaaatcttctcttgccatttgtggctttaagttgtcctaaatgaaacaaggtgattttatgtgtaattttcttcaaattagggacatggcaaagggcctatgcaatttctgctccagatcatcaatatttctttgtgtgtggcacaaaataggttttgtctttgggactgtagttacttcacacctaaaagctaagttctggctccgtgattgtgccaaagggactggatattacttgtgtgcgtacttcctaacttcataccagtgtaaaagccacaacaaagcgtccacattgtcgtcaaactatgatggttctctacacaccttagttatcaatatgcagtttgtgtccacttaactatcatgaagtcagcatcttgttccttttcatgttttcacattttagtgtgtctgtctcatgtttgttcttgttgtatccccagctcctagaatggttcttggcacttagtggctctcagtcaatatttgctgagtgaaatcacatgattgtacattaataaatatctttcctaaatgaatgcttttaggtactattgaccacttgactttcctgggatgactaaagaacatcttgacatggcagtggttgaatctttcaagaatcttctctgcctccccctgagctatcagatatgagaaaaagattatattaaaagcctcagcaaggctaagaggaatgattggaagttcctctatgaaaaatgggttagaaaaggctatgagggagacatcatagtataatgaaaagaatactgggcttcagatcagaaaatctgcttaagaatgctagctttatcactggctatataataagaccactgatcttactccagtctcagttttctaacccataacaaggagataataaaacttctgttgcattcttaagaaaaaaatgaaatgatgtacataaaagtgaaatcatacagcattgcaaaatacaatgtttttgcttataataattattaaggattatatattgcattgtataaaatagtttacaaatagaaatgtaagtgtaagtgaatatccattaacacatggaatctctatatttctcatattagcaaatcattgtcaggaaaaaaaaccccatcattctgaggtttgccctacataaattctatcataatgcaaaaatagggataactcatcccacctgccctcaatgatgactttgttttttgcctttggtcatttatttgacactatgttttcctttattaaaatgtgaattccatgagaacagaggtcctatttgcttacaaatatttccccagcacctagagtggaccctgacattaaaaaaaatgcactcaataagtatgtctggaataaataaataaatgaatatgataacctcatggagctctgaaatctggtggagtttagatgagcaatgtgtaagtccagacagctattaaaaagtatcataggctgagtggcttataaacaacagaaatttatttgtcactgttctggaggctggaagtctaagaacagtgtgccagcctggtcaggttctggtgagggccctcttctgggttgcaaattgctgttttcttattgtgttctcacatggaaaaaagaggataagagttctctagggtcccttttataagggcaccaatcccactcatgagggaccttcatgacctgaccttcatgacctcccagaggccccacctcctaaaactgtcacattgtgggttagaatttccataaatgaactttggagaacacaaacattcagtgcatagcaaacaatatatcccccaaacctataatatgccaaggactgtgctaaaatacaaatatgagtcaaacatgtttcctgctttagaggaactcacattagtggggagaggcagacacacgcataaatgcaataaatagcagttaatgcacaacatgaggcattcttagttacaatgtggctgctgaggagaaggacctaatacatcctggggttcagggagcatcccaaggtgaggtgcttgaagccaagtagaagtgagcatggaagcatggggaaagaggtgctccaggatgaggggcagggtgagcaaaggcatggaggtagagcatgttctggtgtctgggtgaagaacttacaaacagcttgctaatttcaaggcccaaattataagactgggagctttggactggtagctgcggttaggtagggaccatttcatagaggcctttatttcatgctatacccttggactttgttctctaggtaacgggggagccattgaaggaccttatgcagcagaacatggtcagattggcatcttacccatcaggccttcattctttgaggagtaatgttaattcatctaccactttcccctgatgtatgtttttgtcctaggaagttgaagatcagggatagaaatggtggtccctcggccgagtgcggtggcttacgcctgtaatcccagaactttgggaggccaaggtgggcggatcacgaggtcgggagattgataccgtcctggctgacacggtgaaaccccatctctactaaaaatacaaaatcaaaattagctgggcgtggtggcgggcacctgtagtcccagctacttgagaggctgaggcaggagaacggtgtgaacccgggaggggcagcttgcagtgagccgagatcgcaccactgcactccagcctgggcgacagagtgagactccgtctcaaaaaaaaaaaaaaaaaaaaaaaaaaaaagaaaaggtggtcccctgagcttcggcattagattggcgcctgcctctctgaattttaacattactgcagacaactgcttccttctgactcccatttcagtttccaaaaaccctccctgagaggacatgcatttctcttttcctctgtccttggcattactgagctgttcaatgacaaatgaaatacaggaaggccaagccaagactgagttacatgagtagggtccccatcaggctactcaagcccatcacagtttcctcccacgtgttggaccttctgtgtagtttgatttggttatttccacaccatcctcttttctcctcaatctgacactcctccattttcccaagtggagaagcgaaagtgccactgagacctctgggacagactggactctctcatctctcttttctcatggcatctctaatggggaggaaggaaaagcaggagaattgggagaatagaacacatatttaaaggaaaaaggattggatagaacatcattgtgcacattacattccacatccctttgtgattattagccatttaaaaccgaatggagttttgcagccagagatagtctctgaacagatgattaatggcttaatctgtaataactttacattttatagaaccctgataggcgtccacatctggtgagccaagctatttaaggctgtgttaattctgttaattgctatacgtttatttgaattgctggcacctgcgggctttgggataatgtgtttgttgttgctttttttcttctttaaaaaaaatactcattttattttaccctgtcttgcttgctgtctcttgttgctatctctcatgctatcacttaatttcttctctggattttcttttgggttgtcctctttcttccttactcattttcctccctcttccccatctccgttccgtttttctctaattcgtttgtttcccaagctgttgttttggtagccttcctgatttctcaggtggtgataatgtctctgtccataagcaggtgaatttaggtcatagctttgggcctaaatattcctttttcctgtcatgaagactactgtgcagcgtagggctagtaaaacccaagtgaggcttttagaatcaacatgagacatgagaagagggtgggcttcagcagcacaagcccagggtttgagtcttgcctagactcattccttgctagttgcatggcttttagcaagccgcatgactgttctgagcctcggtttcttcatctataaagacagagactaatactgatttcatgtatttttatgtagggagcaaatgggattagacaaatggaggtgttttataaaatacaaaacactatacaaaggttaatgaagttgttatttatgttattaattgaaacaaaatcaattagttcaggccaaagaaccacttactgctcttcaccatttctgcaattaaaaacctgcagaagttaggagagtccaatgtagtttaattaaaaaggcctgatactgggttcagttctaatgttaattagaaaattatacaacttctctggatatccttgtcttgatctgtaaaatgaggatagtaatccctgctaatccaaatgcacactactgtagagaccttcttgtaaatgtagcatagaacacacattattgctttgggtagcaaggtaaacatcttgctgtacatctttattccattaaggaagatgtacggaaaagcactctgtgggtttggagataagagcgtcttgacagaatgggagaaccaacacaaaaggtgaccagaagaaataagagttgagcaaggtggaaagaagtgaagatgcaaatcagaggaaatggaggaacgtggcagaagaagaaaacaaaaagcaattacggcatctcaggagctaactattggcttgtcatgggctgagtgatgtcctctgcaaattcatatgttgaagttctaacctttagtttgtgactgtttttgaagatagggctttttaagaagtaattgagatcaaatgaggtcatatggataggccctcaaacaatatgattggtgtcgttataagaaggagtgataaggacatggatatacaaaggaaagaccatgtgaagacagagggagaagatagccatctacaagctaagaacagaggcttcagaagaaaccaaccttgctgaaaccttgaacttggacttctagcctcctggagtgtgagaaaataagtttcggtaaagtcaaccagtctgtggtattttgttatggcagctctagtaaattatagagcttttttatgggttgaccataaaaaaaagatggccatttttggctgggcatggtagttcacgcccataattttagcactttaggaggctgaggtgggaggattgcttgagtccaggagttggagaccagcctggtaaacttaaggagactgtgtgtgtacaaaaaacataaaaaaatttagctgggcatggtggcacacgcctgtggtcccaggtattttggagggaggtgggaggatcacttggacccgggaggttgaggctgcagtgagccaagatggtgccactgcactctagtctgggcaacagagcgagactctgtctcagaaaacaaaactgccattttttgtgtgtgaggacaaaaaaaaaaaaaaaaaagtcaaatattggcaatgtcgggtgattcaatttcagaaagaaatgtttgtaaagaggataaattgaatcttctggaaaagagatgactttctggattacaaggaattgaagtgggcaggaaagagagagagaaagaaagagagaaattggcaatgtcagtcgattagagattcccattcccctggctgtggttgttttctttataggtggactcctaatgcagtttggacccataacatacagaggcacagaggaagaaggagcgaaaccctcagctactggggacagggatacatttgaggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattcagtggcacctgctccactcccagctccgttagtgagcatgtgatccctaaatcaattagagactcctaattagagactcctattcacctggtcatggtttctttcttcataggtgagctcctaaaccaatttggatccataacatacaggctcagaagttttgtctatatgttgtagggaaacagctctctcctgctttgggctagaacttggagtggtgttaaactaagcttctggccactatcttgccaccatagtgaccaaaaaggaagccaggatagagaaaatcagagccaaaagatgggaagaaactaggccttagtgacatttttgaaggccctggtttaaacagttttcaaattagactaccccttaatttccacttatggttgaataatgtacctctgttgcctaaacctgttgtggctctattttctatcatttgcagcaggaagccctaggtgatgtagcagaattcctcatgttcctattttactcctgttttttgctaacaaaaagataggtccttggacagggaaagacagacaaaagtaggaaatgtaatactggaggatcttagaaatcagataatttgctctgtattaattcaaatttcctgcctcagatgaatgctatcccaggatacagagagaatttgtaaatacaatttttgaaacctagttggtggtttttgaggaacgctagtgaataaagaaggttcctaaagactagacaattgaaaaatgtagataatgcaaacaatgaacttatgagttgaactgaaatctggataacattttggagtgcaatattaacagaatgtatgagcccatagcagagaaaagagtgatcaatataactgccatcactaattaagagcactaagaaaaagctatatcatatcaaccaaattcacatactcattcagtagtattaccgatgattcagaaaagtactatggacctcatctagctaaatagcagcaaagtttttgaagacacattttgtgatattctcattaataagatgagcaatagggtttagatgcaagagctatcaagctattaaaataccaatgggccctgattaagtggatttttttggcctatatgaaagtttttgtaagatggcacaaagctctgtcttatattaaggacttgaagagacataagagaacatggcttgttaactttgtggatggcagggacagaaaatggtagaaattgtgcatctgtgttatctgaggttgaattaatagaggtctgacctgtgcaacaaaggaggtaacagttctgcagtataatttattggttaagaaagcaggctctggagttagagtttctggctgcaaagcctaactctactcccagtagctgtatgatgctggataacatacctaaccttctgttacttattaaatgggaacaataattatacctacttgatagggctgttgtattgagatcatgcatgtaaaatagctgacatgtagaaaatgttcagcaaatgttatttattttttttctgagacagtttttttttttttttctgagacagtgtcttgctctgtcgtccaggctggagtgcagtggtgcaatctcggctcactgcaccctccaccaattctcatgcctcagtctccgaagtagctgggattacaggcatgtgccaccacacccagctaatttttgtatttttagtagagaaggggtttcaccatgttggccaggctcatctcaaactccttcaagcgatccatccacctcggcctcccaaagtgctgggattacaggcataagccactgcgccaggcccagaataagcttttaacatgacaactaattgacagattagaatatctttagagctgagctgtaaaaaaaaaaatacccaaaaaactaaggcattcaagatcctaacaacgttaagaaggcttaactaatagaaccagggtcatttaacctgagaaagtgaagatgcctgtgcccaaggtttgagagtcgtcttcatacatgaaggactgtcctatggaagtggaagaaaatgtggcccatatatccttaagaagagaaactaagtctagtgagtggaagctgggtacttaacataaggaagaactttcagtaagagctgtccaaaactgccttcaaagtaatgagttctccaacactcaaggcatccaagtagagactgggcaaccattttgctgaggttatcgaggggattctggaatcatatgagtggttttgattttatagatagatctatagatagattgattttatatgatagatctatagttctacgatgaatgacctatctgcaaagaaagaataaggctaactgattagctcaggttcatcatgtggaagactttcctcattaatctccaaatcagttggctttacatgtcccacaaacatttattgggttgcccttgtggtaagagttgaggttcccagccactatcatcacctattactcacttacaagaatttatctttactcagtcctttacttgatcatctcgaaaaccgttacaaccacagcaattataatcatagcagcaacaataaagactagcaattattgaacacttaatgtgaacacatgtgaaatgtgtgtctacatggtgctatgtacttcagacttattccctacttatttcctaatttagttctcacaaaaaagcttatgagctggattctatgatcattactaacttgaatttaaagagagcgagtgtctttcccacttacatcattctaagtgttggagttgagatgtaaatactgtcaacatcctgattttgctgccctttctaccaattcagtcataagagttagtgacgaagaaaaggaagctcctctggaaaaggttggtgattctgtgtttaaacttactgtaaggaattgtctctcactaccgcttagagtctctacttcataggaaaggtcatttaatcaggcaaaaatgttctgttgggagactagatacaattacctatttctttcaccttgccattgattgttctgagaggaaggcagtttttgcttgatttcccactttgggcaaattgatattgctcaacctgctaacggaggaatgattttcattatggtacctgagagggaagatgctgctcttagtataaatgccaagcagtgcaatagtttcgtcttgagatgggcagcacattgtttctttttgttccagcctaatattttccatgaagttggagctatttgcctttaatgccttcaaaacacccaaataaggagcagctactatttagacttattatgaattttcagtctgattttgggaatcacttacttagctttgcatttttttttcttttttgctcgtcaagataaattcagtggaactcattgctttctaaaaatgtcacttatttacagcaaatgtaatctaccacaacattcctactgagacaaaatctcttgtgtctttgaaagcctcaaaggagattaaaaaaacactagtccttgtacacatatacctacagggataaagcaatcattgagctaattaattagcttatgttttcaaaaattgttttgcaaatgcagaaacgactattccattagtgttgcggtgcttttgtaaccttgtgttctgttcctcatgtggagagtgtgccacaaatagttcctgcatagatttcaagagagatacaaggacacatttttcacttctcaaatcagtgaagatgcagcttagggcagcaacactgcacaccaattatcaaccaataaaattctcctccttccctctcccttagcttttccctcaccacccaatatcagcagatgttctatctcatactttgtagggaaaatagaaattgttcaggtaatgcttgctaagcttctctctctccaccttaagacttaccttcaaagattctcattgctaccttcttcccctcatcttacagaatgaactttcccctcctctcttgcctcttttgagatttagcccctttaaagattccctctcttaatcttcgatctcccattctcctctgctccatcccttcagctagagacatactcaaaatcacttctttgatactgtctcctgctcaatttacacctaagctcattccccactttcaatgaaaaagttcttgggagaatggtacatatttctgatgtcccctacttcatggttactctttaaccctctacatttgcatgtcagactctgaactctaggatccttagcactttagtggaattgttttcttgttttaccctgcttaagttagaagtactttattatatgctcctatagctctcagttcaaaacttcaatgcattgcaattgttattatagtcctcatcacattgcactttaacatgcactgtgttcatatgtttcctcaatagactgagcttctaagagacaagaacaaagatttatgtagattgcatattccctctgaagttaaacataggtcctgacacatgaatagatgggaaatattcttcaataaattaataagtatttgtgaacatcagtgatagaattattgttccaaagttccaatttctgcttatattcattttgtcaacagcatgccactcatttacttattcatgaatgcagtaaatattcatggaatgcctactctgtcataaaatctgttcaaagagtgggagtgtgtggtgaatgacagcatgtataaagtctatgaccctatggaattcacattacggttgaaggagactaagaataaatgcaaaacagataattcagatactttcagataatgataagtggcatgaaggaaatgaaagagaataatgggtgtattagtccattctcacactgctaataaagatatacctgagactgggtaatttataaaggaaacaggtttcattgactcacaattcagcatggctgaggaggcctcaggaaacttaccatcgtggtggaaggggaagcaaacatgtccttcttaacatggcagcagcaaggagaagtgccaagcaaaggagggaaaaagccccttataaaaccatcagatcttgtgagaacttacttagtatcatgagaacagcataagggtaaccaccgtcatgattcaattacctcccaccgggttcctctcatgacacgtggggattatgggaactacaattcaaggtgagacttgggtggggacacagccaaactgaatcaatgagatagtgagttggtctccaggagcctgagtggtcagggcaggactctttgaggatgcaataattgagacctgagatgaaagtagcactcagttacacacacaaaaccttggggagaggccattccaatccaaggaagctactaggacaaaaaggacctaaagcaaggaaagcttggcacattcaagaaaagtccaggaggcgatggtggccatggctcagtgagagaggtggtgagaggaaagaaatatctagggctggatatgttgcttttctgaaaagatccaggctaggcaatgtcaatttatcaagcttatctctgcctcagagtcttcattttccttttatcccatatctaggttgattttctctttttctttatcctcgaaagtgaggtgtccctctatctttgtaagctcacatgttactgtgctcagtcagcatctccttctctccctttcaacttccgaattactcagttattctcattctttcttgcagtatatatctatatattttttcttttaaaaattgtggtaaaaaaacacatatcccaaaatctactcccttaacacaattttaagggcatgctacagtatttttgactatattcacacggttgtacacagatctctagaacttttctcttgcacctttgatatttgcctatttgtttcttcttctcagagttaaaaacaagtgttagtctatcctttcataaaacccctctcttgacctgcactttattaagctcaggaagataaaaaatgcctctttccaggagacggtagggaaaaagccaaaacaaaatggttataaggtttgaaaaaggaaagataagaaaagcagcattggatgacccataacttctagaagccagggtgggtgcagtgtgctaaatgtgagaagaatggggcgtggttatgtagaattcaataggtttagaacagctcatactgtcattacctattcactcgagttagaaacctcaaagtgagatgtgatctttctttctcattccccttcttcctttttgccctcatttaatcaaacacaaaattcccttggcaatgccctgtatatttctgactcatctctgtcctctgcttcctggtcctttcactactgcctctccctctgcccccatagtacttcgcctatcatggtgtcatgatgagtctttccacctctgttctctctgctttctttccatgctgcattctgccccgttttgctctttgtgccattctttggaaacatccagtgcccagcaaagcatgtcttcttcagcctcccactcaaggccttctgcagtttgtcttcaacttgggtgccacctcctcatagttcctccctaaatttaaccagagtagtcttttcctattactctaaatgtatgttttaagttctttcttctataacttgtttatttggttcttctagccaagaatttctccctttctcttttctgtctgatgcttaccctttcttctagaacctagctcatggtcacctgcttgactgatcactgggttaacagtggtcttttctcacttctgaattccaagcacacttaatataatatagggtgtttcagctcagatttaggaggtagacttccaggttgaaatttttgtttttctacttactacctatgtgccttggacaagttagttagtgtctctgaaactcagtttatttatctataaaactggtatcttaatagcacttacctcagagatttcttatgaggatcaaatgagatgatgcaataaagcctttagctgaatctgtttcgtagtgagtactcaagaaatactagctattttgtcattcagttggtccttacaataccccatagccatttgttagcttttctggcttgcatacaatccctttgaaaacagagtttttgtagttacagcaatgctgtatataatatcaaattattaaagacagtggaaaagaatttatatcccccaaatgaatgtcttgactgactgtaagaaagttgctgtttctccttattacattttgaccacaattgaaatgtggtcaaaggagaccatctgccaaaggagaataattacttcttcacagacataggaaaaaaaactcactcatggataaatatgtgtgcatatgtgaaatatgaatgcagtgatttcacatttttaaaattcctggcaatcaaatgagattgtgatagattatcttttttttttctgagatgaagttttgctcttgttgcccaggctggagagcaatggtgtgatatcagctcactgcaacctctgcctcccaggttcaggtgattctcctgcctctgcctcccgagtagctgggattacaagcgcccgccaccacgcccagctaatttttttgtatatttggtagagacgggatttcaccctgttgaccaggcaggtcttgaacttctgacctcaggtgatgcacccacctcggtctcccaaagtgttgggattacaggcgtgagccaccgcgcctgaccaaattatctttcttagagtaacttttcttcatagatattaatgtaacagttcttatggatgatgtttaaaatgcttaaggaagcaaaacttagctgtaaaattgggtattgcttgatgatcaccagtgtcccattgaggtctaaaatgcttatgaagtttaaattgctttgcagtgtgttatgatctttcaattatctttaaatgattgatttaatgagcttctattattatattttaggtatggtgtttggaatgcaaagtgaactggacagtttctttcctggaagatcttatagttcaggggttgacagcattttctataaagggccaggttagtggcttctcaagtggagacaagtttgaccccaagaaatatttgacaatatctggagactcttttagttgttgaaactagggtggaggagtggttggaggggagtaaagggatattgaagggaagatgctgctggtgtgggcagaggccaagattgttggtgcactgtaggcctacaatgcacaggacagcccttcggtgacaaggaattatccagtcctgggtctcaacagtgccgaagctgagactctctggaccagacagtaagtagttttggtttaatgagccatatggtctctatcacgactatcaaactgtcattgagcatgcgagcagtcatagatactgtataaacaaataagtgtgtctgtgttctagtaaaactttatttagaagagcaggaagtgaattgaattggccccagagggttagtttgctgactcttgctatagttaaatggcaggcaaaacttgataattataatgcaacatattaaactctatctatctatctgtctgtctgtctgtctgtctgtctgtctatctatctacctacctacctagatctatctgtctacctagatagatagatcagtcaaagttttcacaggtttacaatgaagccccagataagagcacttagcctgatctgagatattagagatggtctcctgaaagagaaagaacatgaacaaaagttaaaaaaaaattttaagagtgaggagttagacaaaaacagtaattccatagagagagaatagcgtcagtaaagtcacaaaaatgcaaaatagcatgataagcatagagaactaataataagctaaaggaagtagaagtggcggtaatggtagtagtagtagtagtagtaatagtattgttcccggaaagggatcctgatccagaccccaatagagagttcttggaccaagaaaaaattcagggtgagtccataaagtgaaagcaaatttttaagagagtaaaggaatgggaataaaagaatggctactccgtaggcagagcagccctgacggctgctggttggctattttatggttgtttcttgatgatatgctaaacaagaggtatatatttattaaatacctgctaaagaccaggctctgtgctaccgtgctacacaggtagtttgattattacaggtctgaggcctgtttgtccggatgattttagttcacacccatagtgacacacgggtctcttcttgcttcattgctttttccctttttctgggaaagggaagaaagggagggcgattcctggaactgaggattcctctcctttttagaccatatagggtgtcttttaacatgctaataactataattagtgtataatgagcagtgaggatgaccagaggtcacttttgtcaccatcttggttttggtgggttttggctggcgggatttttttaaattttatgtatttatttattttttattatactgtaagttctggtttacatgtgcagaacgtacagttttgttacttgggtatacgcatatcctggtggtttgctgcacccatcaacccgtcacctacattaggtatttctcctaatgttatccctcccctagccccccaccccctgacaggccccagtgtgtgatgttcctctccctgtgtccatgtgttctcattgttcaactccctcttatgagtgagaacatgcggtgtctggttttctgattttgtgatagtttggtgagaatgatggtttccagcttcagccatgtccctgcaaaggacatgaactcatccttttttatggccgcatagtattccatggtgtatatgtgccataatttcttaatccagtctatcactgatggacatctgcgttggttccaagtccttgctattgtgaatagtgccgcaataaacatacgtgtgcatgtgtctttatcgtagaatgatttatagtcctttgggtatattggccggcttctttaccacattctgttttatcagcaaggtctttgtgacctgtatcttgtgccaacctcctttctcatcctgtgacttagaatgcctaacctgggaatgcagcccagtaggtctcagccttgttttacccagcccctattcaatatggagtttctgtagttcaaatgcctctgacagcaatagcagttaacttttattgagtgtttaccatgtgtcaggaactctaagtattttacgtgtgctaacacatttcataaacatagagctcagtgttgctggagtaatgtaaaataaggtttaagatgtgtgcatgcaccagggctagggccttatttttaggtggatataactgggtatgagaagaccaacaaggaggtaatgagtaagatttattaactgattggatgttccaggtaagggcaggaagaagccagaagtttctggtttggcaacattaattgaatgtaggtatgctggaggagaggcaggcctaatggggaaagtgctgtttttgatgggttgagtgggaagtacctgtgttaactgcagaacaaggtcaagtcaaatagctggagttgtaactgtaattagaatataagcaatagagttaaattaattgaaattgatgagatcagttaagaaaccacatcaaaaggaagaacaatgtattttaaagaagacttctaagagtaactaatatttaaaagaaggcttaaaagggaaaattagtgaggtaggagaagaactagagaaaacgttgtcatcgaagctaagaaagtaggaagtttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtaccccaaacatcagcatcacacaatatatcaacctgcacatggaccctctgaaactaaaagttaaaagtataaaaataagtaaataaagtcaaacatgtgaaaaaaagaaatatttcataggctttttttcagttgctctaaatttttaaaaatacgtttatgcattttcctataatttgtgttttgcatttatattctccttttctctaattgattagctctatcattagatttaactgatacttagagtttgattggctcaccatctatttatcataatacattgaaaagtcacagttgaaaactataaaacctcaaggatgtatttatgtgtttagcaaatggaacacaaacctcatagatttgtaactttgagacaccaaagaatattgggagacacttatcaattcagttgagttcaattcagtttaaggcatttgttgaatgctatgcatttttaacagtgatatgacaggatttttctttcctttcaaagcagcttgccatcttatctgtctgtatgtttattgcataaagaatttacagcagataaagatgtagttggtgcaaaaaatatacagaacttgaaagatctaatcataaagaaatataacaaaatgctatatcatatagcagagtcagtgatacaaagcaatttgtactaaagactttgggagggagagaccaacatgaactagaatattgtgagcatctccatctaatgtttctgcctaaatgctgttcttctctagacagaactcaaccaaattactcttaacagaagaacaaatgcaagtgatgaagaaccaagggacaagcaaaggcatcaatatattgtttgctatttgaggaccaactgtatttatttatctttgtatctccagggccaggcactatggctaccatgtattaagtacatgcagtcagtgctgaattgattacttctggtcattagattagcacagctgagctgaggtagcttggaccatgtgctatgtggatgcttccctattaatgatgctaatgacaaagagaatcaggtccaagagacagtgagttgggagtacgccacctatagaggactaggagagaaaatatttttgaaagagaagactaaatgctagatgcactattaatgggaattggtcacgcccacaggactcttccctctagcataacataccgatatataaaaacatgcttgctgtgtgaccgaatgagccaatcctggcttaacatagacaaacaaaaaagaagttgccaatgccttcttcagttcagtatctcatgaaagaaatgcaaggtgaagagaaagcttaaatgaaaaaaataaagtgaaatctgtaagcctggttctcatttctaagggtttattatactggagatttcatgaaaatagtattgagaatgactactctgtgatttttgctagcttttagtccctataggcagaaaagcatttctaaaagagatttgaaaattgtggactctgataacactgctagttgtcatgtttttctctaatgaacagcttatcagtaaatgtgctcagtggttaattaccacattagagtttattggcatcaaatgtagtagaatgccgattatccttatgcaaatttggatttactgcaggttaaatcctgtgacctgaaatctaagtcacctgtcataaattaataggtccaggtactaggcctgctgggattggcagtgacaaaagaccccatgagttgggggaatgaatcaaacctgcatgggcaagattcattctttggaatgtctcacaaagcctggtgcagccaattgtgctgcagaggctgtgtggtgtttttgtgttgttttgattttgtttcattttacagggcagccaggcagtccaagcaatggttcaagccactattgatgccagcggtgtcatccatgaggtggcactggcacttggaggttataggagtcaggtggagctatatatggttccaaaacacatgtcaagtttggggtgtgggtacgaaaataaagacagattcccagatgtctccgtcagttcaggctgccctaacagaataccatagactgggtggcttaaacaacaaacatttatttctcatggttctggaggctggaaagccgaagatcaaggcctgcttcttggtctgcagatggccttctttttgtatcctcacatggtggaaagcagagatcatctctcttgtttctcttctcctaagggcgctaatcccactcatgagggctcctactcatgatctaattagaaccaaaggtcccacctccaaataccatcatgttggagatcagggcttccgtatatgaatttggggaaaatgtgaacattcagtccatggcaccttccgtaggaagtcttgtcatggcccaatctaagcaaactaaagttcacagttatctcaggttttttgaggggagtggaacgtaagacagcatatccaagaccatcatccaaaaacctatgcctatagtgggcccatgtgacagagcagatatggctgccacccagtggccacatggcagcccatagctcatgagtgctctctgggtttgcagaccgaactgcctatcagaaactgggacagaagcagctattatgcctcctgtccctgtcaggactgggtcaggaatgagggcattagggcttttgtgtgtctctcagattaaactctgctcacttgaggttaaaacaaggcagaagctggcctgagataatcaaagcctctttcaaatctatttgcttataaaggcaaggtgtttttggtgtctacaaacttctaacacatttgtaggcactgattattctgcaaataatgggggacctttctgaagccctggatccctggccaatgcaccctactccaagcacattgaaatttttaacaaaatttttaataaaattgagagatccttggcatctcaagaacaggaaaatcattacttcttcaaatgaatcattggtgctcataagggaaaagtctttcatgcctagggcatgtatccagataattttggtggggaataacatttcttaccacattgtgagtgtttatgtggctggggcaaaagaagttgtggtttcggtgctgatccattagcagtgagtgtggtaggtgaaagttccttaattgttccccagagtaaaaacatcccagtatttatagactattaggggagagggggttggagaggcaggtgacttttcagccctacactgatgacttttatgtcttccaggtcacattaaaatgttttgcttgaattagaataaaagtagtcctttttgtccactctaaattcagtgtcttggttgaaagtatccacagaaaacattcctcagtcttcataatttcccatttacaatagagaagcaaggctctctgtacttaagaatagtacaagctattttagatgtcagatgtagtctaagaatgattgagtcaacaaaggagcatgaagacagtgatgagttctccacacagcaggtgctcagtgtagggtgataaagaactagaatggcagctaagtaggtggcaccagactctgaagaagcacttagtcattgtctagaatgtgccagaccaagtgcagttttaaagctctctctggtctccttgtcctgtgaacagacataaggcctaaataagaggcagaattgggaggctttttctttgcacctcaccttccttaccacctggccttctaggcattggagacagaagagaatctcccacatgcaaatcagcccccaggtcatcttatagcaacaaaagcctgggcaagaattaataaagaaatgagtggaatctaaaagtctctaaacataaagaaatacctgtaagatgtctcttctgagagcccattatatagaaaggagtcaaaggaagaagagaagccaagtgcatggatccaggagagtaactggtccagtgcatttctgtttaccatacctttattcctctaaattttttcagcagttctggagtagctccattagatccttgatgagttaattttgccctagatcaatttcaaagcttaaggatacagtgagaagagaaggtttgaaataccttagggaaattacaggatcaaataaattttattattatgccagctcagacagattggtagtgttgggaaagattctagtgtcacaggaaacaactatcctgaagtttctatggcgtcttctgggccatattttaaaatttgactattcaggcatacctcattttattgctctttaccttcttgcacttttgagttattgaattttcttttttcaaatggaagttttgccgccaccttgcatcaagcattttccaacagcgtgtgctgacttcatgtctctgtgttgcattttggtaattcttgaaacttattattatatttgtcaatggtaatctatgattagttatcttcgatgttactattgtaattgttttggggtgccatcacccatgcccatgtagaatgttcatagataaatgttgcatgggttctgactgttccaccaaccagctgttcctccagccttctccctcccttcaggtttccctattctctttgatacaataatattgacattaggccaattaatagccctactgtggcctccaagtgctcaagtagaaagaaagagttgcacatttctcgctttaaatcaaaagctaaaaattaataagtttagtgagaaaggcatatctaaagttaagataggctgaaagctaggccttttaggcctagctgtaaaggcctaaaagttagccaagctgtaaaggcaaaagaaaagttcttgaaggaaattaaaagtgggcacatgaatgataagaaagtaaaacagatattgctgatatgcagaaagttttactgctctaggtggaagatcaaaccagccacacatttccttaatccagagcctaatccagagcaatgccctaatgcttgagttttatgaaggctgagagaggtgaggaagctgcagaagaaaggtttgaaattagtaaaggttagttcaaaaaagccatctccataacataatagtgcaaattgaagcagcaagtgctgatatagaacctgcagcaagttatccagaagatctaggtaagatcattgatgaagatggctacactaaccaacatattttcaatgtagataaaaagccttctattggataagaaaccatctaggactttcatagctggagagggaaagtcagtgcctggctttagaggacaggctaaactctcttttttgaatctaatatagctggtgactttaagttgaaaccaatgctcatttgccattctgaaaatcctagggccctaagaattatgctgaatctactctgcctgtactctgtaagttgaacaacaaagtctggatgagagcccatctgtttacagcatggtttactgaatatttcaagccaatttttgagacctactactcagaaaacaaagtattttatgtaaaaatattactgttcatcgacaatgcacttagttaccaaagagctttgataaaaatgttcactaagattaatatttttatgcctgctaacacaacatcattctgcagctcaaggagtaatttagacttttaagccttattatttaagaaatacagtttgtaaggctatagcttccatagatagtgatttctctgatggatcacaaagccttttagaaaggattcaccattctagatgccattatgaacatttgtgattaatgaggaaaggtcaaaatatcaacattaacaggaatttggaagaagttgattccagctctcatggatgactttgaggtttggaagaagttgatcacaaccctcatggatgactttgaggagttcaagacttcagtggaggaagtaactgcagatgtggtgaaaataggaaaaaaaaaaaccctggaaggagagcttaggatatgactaaattgatgcaatctcatgataaaacttgtatggatgaggagttgcttcttatggatttgcaataaaagagcagtttcttgagatggaatccactcttggtaaagatgctgtggacaatgttgaaacgacaacaaaggacttagaatattacataacttaattggtaaaggaatgataaggtttgagaagattgactccaattttgtaagaagttcagctgaaggtaaaatgctgtcaaacagcattacatgctacaaagaaatcttttgtgaaaggaagagtcaatcaatgtggcaaacttcgttgttgttttattttaggaaattgcacagccaccccaacattcagtaaccactagcctgatcagtggttatcaaaactgaggcagaccctacaccagcaaaaagattacatctcactgaaggctgtcaacttagatgactgttagcattttttttaacaataaagtgattttaattaaggtttgtacattgtgtttttagacataatgctattacacacttaataggctacagtatagtgtaaacataatttttgtatgcaccaggaaatgaaaaaacatttgtgtaactcactttattgtgatagtctctttattgcagtggtctgtcactgaacccacaatattaatatttttgagatatatctgtatgtgtttatgtccttaagcaatatatattacactttgagtgttcaaaatttatataaatggtatcatactgtgcatatctgtacagcttactttttaaacataatgttttgtctatgttgataagatttatctatgttgatttcattcattcatattaactgttacttcatgctccatacttttttttttttttgtagagacagggtttcactgtgttgcccaggctagtcttgaactcccgggctcaagcaattgactcagcttccctaagtgattggagctaaaattatctcccaccacacccagctactccagtatattttcatccacagttgtgccagagtttatctagtacatatacctagaagtgcagtttcctgctaggtcataagctggatgtttataactttactaggtattgccaaattgctttccaaagtgatgtacaaattcacactcccaccagcagaatataaatattccagtttccttgcatccttgacagtttttggtattgccaataaatcaaataatgtagtataaaccaactcaatatagtgtaagccagatttaccctgtaaaacatatgcctaaagttcccattttaaggtccttgtttctactgagaatccagaggcctcaaaggtgcatatattgcacattacctccctcatttcctattctactaagccccagtgagtggccttccctgcaggtgtcagcttggagctggtctcttctttattagcaccaagttgctgtcttttaaatttagaactgttgtagttcttctagtcctgcagaatttcattactctggcctcaattgctcacatgtaccatctttcaaaaatgtcaggatagatgagaagatcacagggccatactctccttcagacgataaagcaaaacacaaccaaaccctcaaagcagatatgattactgcagcaacaggaaataaaggcacaaaaattgttataaatgattgttttcatagaaaaaaagtattaccaaaatacattcattttttacccactgtaggcttccctctttggaggcattgattagtagatacgaaatccttatcttctctctagagtttgaaatgtataattaacaatggagtctgccagatcaacaattctcatcacagaatgtcctgtgttttagtctttgtggaccatatggttgatctaccttatcattgttattagtgtggacccttttttgtgttagtctttttcttacattttctacaatagttaaacaaaatatttatttttgttgttatatgattttaaaaaccttatattattcagcttagcctgaaagcccaactgtgcaacagaaaatggctcttctcttaattaattaatttcaatttgatgaattaactttaataacatgctaatgtatagaaagctactaaatttttcagaataagtgtattgaaatttctcttccaagagtgatgccagctttgcttcctttatttgtgagtgggaagtgaggtttaatgctacaatggccttctagaaaccctgaagcagtagtttgacaaggatggaaacgttgagatcattgaattattgagcttgaataaacttctgagcattcattgattaatttatcaaataaccatgtattaaacacttccatatgtcaggcactgtgctaagtgttggagataaaatgatgatcagggagaagatatccttctcctggttcaaatccgttgtctagttttcatcagcttttgagtcaatataatgtttaaggacatgagattctacagccaaatagaaggatttctattgctctttggttttgacatttaacttgaaaagtaacactaataatgactaatctataatctaagattatataagtatatgtataattacatataattacatattttatattgtgtatatatgcatatacatggatggaactggaggccattatccttaccaaaccaacacaggaacagaaaaccaaatactgcatattcttatttataagtgggagctaaatgatgagaacacatggacacatagaaggaaacacacactggggcctgtaggaagacagagggtgggaagagggagaggatcatcaaaaataactaatgagtgctaggcttaatacttggtgatgaaataatctgtacaacaaatccccatgacacaagtttacctacgtaacaaacctgcacttgtacccctgaagttaaaagttaaataaagaaaagaagcaccttttctatttattactgaaaaaatacatattgtaaaccttaaaaaataagagacgacaggttcttgagcagaaactgtgattcagaattttggattggctgcacttgaaatactaacataaagactggttttgccagtggaatctgagtttggaatttgactcctttttttcctgctactcccttccccagcttgtacatgaatgcagtcttctagctcatttaaattagttctttaacttatagcaactgaaagtagagtggtttgattttatcaactggaacaaacaactcaacagtttttgtagtttttgtctgttgctgtccctctccttttcagatgtcattaagtgactttcctgggcttaagagtctaccctgaggacctcaatactctggtttctgcccaagttgtctggtctacctcctgaactagcatgtctacaatctgaggaaatgcaccctaaattgataccctgatattttcagtgggctatggattggcaggaagagaccataaacacacactttatttaatttctgagttaattatccagggataaaagtattatcagaaacatggtggctacacaggaaagcaacagatgtagtattcactaaaacagcttcatttggtacccagagtccttcatagcagcaagcagctgatagagacactccatttgggggttgagtccttccaaatctttctggaaagctcaattctttctatgacacagtcttatgtgcttggggcttatgtcacattctaaaataattgacattgacaatcgatgcatgcccatttaaaggattgtttttgaacactggaatctgtcagttcttaatgcaaatgtagcatagcaaggccacatcttcttctggagcgggagttagaatccacgtgcagatgttctggacaaatggctttgcttccagatttgcaaaatgttcttgaaaacccttatccctataggcacagataccataagagaaaaaatagaaataagtaggaatcgggattgggatttgcttgaatctttacagcaagaccctctccatattttcagttttcaaaatcagtgaaatacttcagatcagtggtttgtaaattgctctgtggagacctcagattctttgataatgccagaggaggaaacataagtatttttcgtttgttaggacctcaatcattcctggataatgaattttcagaggggaatggacttggtttattttatagactgtttgagcctaaaggaaaatgactacacctcccaaagcagatgactaattttcagaaattgttttttggaaaagtgggtctcctttttaatttcccattcgcaccccatgtatgttctcttatcagtgaaggagatgagaagccactctggggaaaagacacgtagaagatcaagaaagctcttttcctcattgcgtgattgatactcggttttgttttttttgttgttgttgctgttgttttatgggagtcttgctctgttgtcaggctggagtccagtggcacaacctcggcccactgcaacctctgcctcccgggttcaagcaattctcctgcctcagcctctccagtagcagcgattacaggcgagcgccaccatgcccggctaatttttgtatttttagtagagatgcggtttcaccatgttggccaggatgatctcgatctcttgaccttgtgatccacctgcctcggcctcccaaagtgctgggattacaggcgtgagccaccacacctggccgattgatacttttttgttggttcattccagtgctgaaaattgggctggatttgccaaaacaaatctgaaactggctttctatgcctgtggattctgttcctattgtctgtccattcactgttctgtttagttcatggattaagactgtcagcatcacgaagtatcagcagtaggatgtttggtgcagggaagatgtgagcacctgcatatcttccctgcaccaaacatctgatactttttttttttgaggaaataaaagccccaaggaaccaagtacgacactttgacagtcattgggctttttgagcctgggccttgttaaggcagctgcctgtaccgttgtggaatcacttcagctactgtctagtcctcagtgctacagcctcagggcattgattttagctaataatagtggtcaacattaattgagcatttactatatgctaaacagtgtcctaagtgcttacttgtaggaactaattcagtcctcgcagtaactctaggagacagatactacactgtcattgtggatgggatggggtttgggtggggaattggggtggggcttgttggggaaagaatctaaagcacaaagatagctttcccaaggccatgctgctgatttgggtttggaactgggattaaaatccacattctcatgggttccaagcccatggttatagtcagtcattatgttccacttcctcactagctcttcatcaagtattatcagaaagcaaggaattatttttcagactagcagaaatttactagtgacttagtaatatgtcagaatgtcatggtagaaaatcattccagagctttgctgtttagtacagtagccacaatccacatctggctgctgagcacttgaaatgtgcctggtctgaattgaggtgtgttttacgtttaaaatcacactgtatattgaagacttaataccaaaaaaagtgaaagatcttagaaaaagtttcttatgttgattatatgttgaaatgataaaattttggatatattaggttaagtaaaatgtattattaaaactaacatcactggcttctttttacttttaaaaaatgtagccactagaaaatttataattacatatgccacttattttatattgctattggacattattctagagaattaaaaatgtgcaaattatccacagccatttcctcatacctgtgacactcagtcattcatccgaattagcttgtggtcagtttgaggcagtttgtctaacgtttgagttacgagatcagagcaagaggtgctggtccattttagacgtgctttatttagtttgtagaaaaacacactgaaccatcctattccgctacagagtgccccagcttcacaaagcagaatatggaagggtagactagtgaaaataagtaaatacagataaataggttatgacatgtagttgagattcagataagtggagcaagattccgcagattgcactgtattagtgacagtgagtgtattctaagagaggagaggatctttatgtgtggtaaaagtagctggggaccaagttgttgagaattttgtatgtcaggaaaaggaatgcatttggagtgacaaacttttgtcactttccaaagactccttttagaattctttattgatcaatagaatattttgtcgtgacttacttcataatttatgatatgttaaaatttccaaattttctgtttattttatgttagttacatcttagattgatgattccctggtggaatttggaaagacatcttaatcacaccagcagtatttatgtaaaccatttttaaggatggtttacttcttagttaactctaaaggaaggataatgtcatctattgaataaagattctcacttttctacttggagatcatattgtcttcttaaatctttgtcccttaggctttgataatggactacatctcatctgggggcctctcttctctgactgtattaaccatacttatcttggagttgaaagaccttggaaggaagccaggatctaacagtcagggtctatggatctttggcaagtattacaggcaggccctggatgtgtggagtaacagaggcctctaacgagggggcacaatagggttggcttatgtggacattacattctgaaattggcacatgaggttaaaaaatgcttataatcaaatttggcctggataaggcttttaaactactcctaaattagacgcttgaaagctccaaagccaggatttagcattgttgattttgctttgtatttcttctgagacacccctttccaggagacacggaagtcaggtctacttggaatgaggaaaagggttatgtggtaaatagaaaattctcagtccaggcacaatggctcacacctgtaatcccagcattttgggaggctgaggcaggagggtcactcaaggtcaggagttcaagaccagctgggcaacatagtgagtccccatttctacaaaattagctgggcatggtggaatacacctgtagtcccagctacttaggaggctgaggcaggagggtccattgagcccacaagttcgaggctgcagtgacccatgattgtatcactatacttcagtttgggagacagagcaagaccttgtctcaaaaacaacaacaaaatatcctactccctctcattttttccccaagagtattgaaagctgaatttgtgtaagttatacataaatatcatgcaacttcattgtactgcttattttcctaataagttaattgacttgtattatgctttacatattttgggcttgttacttgtttgtgcctaatgtatgaaaggcagctagaacctatctttctaaactgaagagctctaaatctggttagggaaatagacaagtaaatcaagggttataatgcaaattaagaagtactttaacaaggcctttcctcagtgctttaggaccacagaggaggagccattaaagtgatctgggcatgagtaaaggctgtatgtgacatcctagcctaagctaccatcatttctcattgcattggtgcaacaactttctaaatgctttctctgtttctgtttttgcccctggatctccctctctcccaagtctatagctccctagcagctgcagtattcctcttaaaaatgtaagaggcacatatgctcctatctactcaaaaccctccagtggctttccatcttgctcagaatcagagctcaagttctaaaaggcctataagaccttgtacaatctggcccttgctgcctctctatcctcatctccaatgtgcacctcctcattcaccctgatgcagccacaccaatctccttgatgttctttgaacatgctgttcacatgactgctcaagacttttgtccttactgtagtctgtctgcttggaattgtcattactcaaatgtctgtatggcttgttctctcatgtttccaaagctctgaagaaatgtcacttttttttttttttttttttgagatggagcttcactcttgttgcccaggatggagtgcaatggcatgatctcagcccaccacaacctccacctcctgggttcaagcgattctcctgccttagcctcttgagtagctgggattacaggcatgcaccaccatgtcagctaatgtttttctttcttttttttttttttttgtatttagtaaagcctgggtttcacagtgttaggctgatctcgaactcctgacctcaggtgatccacccacctcggcctcccaaagtgctgggattacaggcgtgtgccaccgcacccggccatgtcacagttttataggcctttcctgactaccctgtacaaataaaaacaagaataagcctccaccctatcctagcactccttcttccgtttagcttgtccatcaccatctaacatgccgtaaattcacttctttatttgccccatccccttagattttaaagttcatgaaagtaaaactgcatctgtgtcatctactttggaacagttcctggcacttagtattttaattcaatacatgtttgttgaatgaataacttacttttctctctggcatggcttccacatttatttgcctaatgagtggatcgataaatgaatgatgactatattctcttggcactagcagaatctgttatttcccaatgtaccatttctctgaaataactttacagttctttattggaacaaaagactttatcaggacttgtcaggagctcttggattctgccaagacagcatctcactcacagatggaaattgccattaattgtctgctttgatggtggagcacaacattggaaaagaagacgcctcctggaaagcaggttttgccattggtgagagagaataagagtgaattgggctggccacagcctccctcatattgagaaacccaattggtaatactcagctagcatacagattagtaatgtgtgagtgtctgcatgtgtgtgcatgcttccgtgtttatatattaccagtgtatgtgcgtacctttgtatatatgagtaaaaatatatatgaagtaaaaaatcaaaatctaataactcaaaatccaaagacttgaacaccccaagggaacactgaagtctcagcagaacccttgatgcttgggaaagtagaaatatagggaaggtttgcataattccctgtgttcacttctagctcactgaatgtgactttctgctgagcctaagcatacagcaatgaataacaacaatagtaacaacatgaggggtccctgctttcatagagcttgcattctagtaagtggggcaaaaagcaagcaaagaaatctaagttatatatggtggtataaatgctatgaggagaggaaataaagcacaatgagggagaagatgatggagtgcattttagaaatgggaattgatagaatctgggatttgcttgacaaaaagttgaaggagaagcagatgcaaagacctgagattcaggtgcttgttgaattcaagggacatgaaaaagaacaaattagggaaggtcaagttatataaagcctttaagccatggtaagaagtttggattttattctggttacaatgaaaaagccatcaagcgctatttagcaagggagtgactggtctgaattaggaaaacccccctggctgttctatggagggtggagtatggtgtgtgctagaagagacagaagatacatagatggctgttactgcaacccagggaggaaacatagcaatgtggattagagtagaagtgatgggaattgtaagtagatgagtgtgggatatattttggaggtagagtcaacaggatttattgatgaattgtacattgagtatgcgaggtgagtaactgaggataactttattagtcaagataagctaggctgtgttgtggcaacaaactgttccaaaatctcagaggcttaacacaaaagaggtttatttctcagtaatttgtatatccctgtgttttggctggtggctttgctttgtttattattgttcttactctaggacatgggatggcagggtaaccactaactggaacattgctggttgacattgaaaagggataaataaaatttaaagggtttcaccctgggagtgattaagcatttggcctcgacatgacacataacacttctgctcaaactaattggccagaagtaatcatatggctccatcctgcacaaggggccgataaatacaatcctgtcttgtgccaggagacaaaggactagagcctactcagacagcaacaccaatgactctatagtatcttcctggtttgaataactgttaatggcattatccaagtgcagatatttgaaaggaatgagctggggggatgtgaaatccatatttcttttttagccttttttagtttaaaagcctattgagtggagatgtcaagaagacacttggagatatgattcttaagatcggagaaaatctaggggtagagaaataaatttgagcatccacaacatgaatatgacacttaaagtatcaggacttataggtacctgttgagaaccctcaagttctatctttggattcctataaagaaggaattcctatagagaaggaatccaaagacagaacatgagggctctcaacaggtagagatcttacagagagaaaaccaacaaaggaaataaaaagagagaggttctcatggtagatagaaacacaagagagtattgaatcttaaaaggcctcaagaagtaagtattgcaagaaaaagggaatgctgagaggtcaaggaaaatgagatttaattattggatctggcaagctattgaccattttactggtttggtataaagaagaggctaatttaaagggggctgagaagagaatggtaagtgtggaattgatgaaaatggtcatagacaacttttggaagagttttgctgtaatcatagcagtaaagtggggtcagtagtgaaaagggacatggtgtcaagaagataggtggtcaggaaagggagcaggtttgtgggccagatgatggttttgtcttttgaaatatgctgacctgataaaaaggtattcaaatgaaaagcattcagatattagttggagatataagtcagacatagagaaaaaccagtgccagcataaacatggaggagccctcttcatagagaaaagagaacagggaacacagatgggctctgataggaaaagtatagagaaaaaagattgagcgctcacattaataaaatcaggagaaaaaagcagattatgtcctagaaatcaaggaaagaaagtttaaatacctttgcaagaggtttttcttcactttctatgttcctggaaatatgtagtctatattctgtactctctggccaaatttgaaggggatagtactgtagctgattaaatatataatctaagaactgtggaataaagataggattaaaggttttttaaatctcaaatcagtggggttgatgctctttgtgtttctgttctttttgttattgttttctcttgttattttgaaatttctctaaaaactacttaaaagtatagttagtgccatactcatcgttgtatttttcttcttttttacctcctcctcctccttcatcaccatcttcactaatgattatcactagcaaaataatcatcaccatcagacttcattaaattaactattttggtattttaataattcagagctatttttcataatttggttagaactactgaggggcattcattttagtataatagaacatttttatagcacttcttgttatttgagtacttattaaatgcttactttaaacatgggcataatttctgccctaagtccttttcagttaaatttcctaggaaagatacaagagttccaggatggaaaagaagtgctcagagggaatacaagagattaagaccacaaatatatggtatcactagaataatttggcagaggtttatttctatttaggttagttggctataataaacatatgtagataaatagtataggaatatagtacagggtaaaatggtgactcaatatcttaatatcaaatgaaaaatgggctgcttcctccttctaggctggaataatgtactattattgacaccccttctctggagtataatttggcttagttctggtggtctgttgagtggcttggtctcactctctttctctctctctctctctctcaacctctctcccctctcccccttcctcctctttctctctgcccttccttctggctgtccatccttctctccctcctccgctcctccccactatctctcacttctccaactcagttctttctatcagtgtcttgacatctaactagttaccctagagacctcaaagcaattattctttccttaaacattctttcaaaacccagtcgttccttaggcatattgacttgaatcatgtctatctttgccattgctaccttcttagttctaatattcatcattattttctgggttacctccatggcatcctaacttgtgcctgcctcttttgttttattccactccaatgatccctcctattcacatgcctctcctccaaccttctcccatcttagttattgtgcttaagaaaattatggatcatagaccaagtataggatagcagtgtgaggaagtagattgaaggagggagacataggagttggagttagaactagttcggaagttagattgtacttgtcaatgagagacttaatccagattccatctctctaggacagaatagaccatttctatctacatggagtatcccttacatgatatccatatttctctcttaacatcattgtacacatatgtttacatgtgtaacacttctactaaattgtaagctccttaaggtcagagaccatgtcctaacattcagtaagctctccatggttgtttgttgagtaaacaaataaaatatggtcttaaatagaaccagtgtcagaaggaatagggtggagaaaatgaatataaaaaagattggatatggaattaaatggacttagtaaaatattaattctgggacaatgaagagagaaggttcagatatatctacacaaatttgagcttaggtgaccattaacagaaataaggaagttgggaggaggaaccgatgagtttgcttttaggcaggttgattttaaagttctgtagagaattttaattttaggtggatgaattgttccagcagacaattcagatttgaagcctgaagctttggagggagttttggtctagaagtaaagatgtgttagtgagtgaaattaccaagacaccgcagtgaaaacaggaaagagagccttcatcagatgcgtgggggaagcctctttttaagaaatttggaaaaggagctgacagaaaatgagtctgaaaatgagaggcagaaatgagtcatcaaagagttacttggaaagtgtacagtcaggaaacccaggaaaagaggatgttgaggaaggagtgagagaaatgccagctattgcacagatattgcatattatgagaatggaggcctatataaatttgagtagtagaacatcagtaatattattttagaattatttgctcttgggttaaatatgttttctcttaggaagcaactaagttaaaacacgatatttagagtgctgcagagacaaggttgtaaaaattctctcctatatcatcggtggttgaataaaattcctttattggtttttcttggaactgtaccctctagccaaacagcccagtggaatccagtgatagaagccaaagaaataaaagctaagtgtctcaatttatcctgttgtcactttcagctttctctgctcattattagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgatctaggtctctgcagatttactaaaggtaatgcaaactcataggtaaaagtattagggcctatataccatcaccttgaaagggagtcccaagaaaggaggggaccttttgttgcatgactacttttaagctagcaaagtgtaaagaaaccttttttggaaaaaaattaattcgagtaccagcatttctgtctatattattgtcagtttgcacccaactcttatttgctgcctcctgtaccaggttggaaatcattctgttatcagctacctgccaacctgacatattcttcctatcactttccccacctcttttgctgattgcagaggggctctttggagcactttgaaaagccacctgattaaagccttcattaggctagaagcagaagtgcttcacaggccaggcaagaaatactttgtaattgcttctgacgggcagatctcctttggcggttgttgagccatcaggaagccgtacagcactggtccacgtgtattttgtataaattagtgggcttgacattacaagaggttgcccctatacgcagtcatcttcttagccccagagttctggaacttacccattagcctgcacctctttatagaacccgtcttacgcatggttctgaactaactgcttctgtcacctggattgcttacaatacctgcttgcctcatgtgctactattgtttccaaccaactatgctagacttcttaaaggttctatttcattgaatgcttttacagtattttctatgactcttttgtctttgagcctctcagattagctttttctacaaaagctgtttggcatgcctattgtcatctattttctttcagagtagctgctaacagccagaagctgctagttatggccaaaggcctcattgttggagagtcgttcttgttctttgactctaggtagagaggatgaaggctctgagatactgtctcaaaacattcatgtgttttctatgacaagtcaaagctacattgtcatattagaggtgtccagtagccccttagcgtgcctcagagtgggaggtagtgttggcaccgaactttgtcagccagtctcttagaggatcttactggagtttgtgattgagcttttacttcttctgttagtgttctgctgagacatatacactaatgatagctgccactctggggtgcagaactttccatatagattgccttaaaaataaaagcaaattttctatgcatacatgccggggaaaactctactaaatattcagtggttccaagaaatgccttttaaccatttgtaatactttagctttctaccttttcatctcattacttattttcaggcagaatagatatagaggcttctttctgcattatagtcttcacagacttaaaggcatcaggaagtagcccttgtgattttccttgctcttcttcttcccatttttccacctcctcctgtaagcacgtactttgtgtcaggcattgagagatacagagagaaaaggcataggtttctccccttgagaggctcctggtctactggaagaaacagacaattccagcacaatgtgatagatacaatgatagcagttagaacatgaagccatgggggcggagaggaagaaatcagctgtgggtgggaatggagtgggtagaaatattgaagaaggtttctaaaaagaggtgatgcctaaactgtgcttcaagtggcgaatagtagttatccaggtagagaatccaggcaagatttatccctggaatgataaattggaggacctgctgaacttttgtcaaggctggtaacaatgaagtgaggactagatcaggaagaggtttttatataatgcttcaaagtttgcatttaattctgaagttgataaagaaccatcgaacaattttaagcagagaatgacatgttattcccagacatgttaatagtgagacgattagagtcatttctagtcctcggaataaaaataacagtagtttcctagtggttcagcaaggtatgttttaaatttcgtcatctttttaatcaaactgcttaaggcttcctttctactctaatagttacctttttcccctaattgcataatgtatatatttttagagcttttcataatcaggtaccacctattcacctcatcttaattcctctgctttgtgacatgtaacttttactctactggagttggtgccctcatcaaatattctaaaacagaaggaaatgtaggcattctctgggtaggtttgtttagtgcctaagaaaatgcaggaaatgagagtgtgtatttattgagcttctactatgtgccacacactttgctaaatacagggaatgcattggttatcacatcagaaacacacaacccatgtgtttatgacgcttagtttagaggatcgaaacagtgccatccctagcaaccagagggcacagaagtacagtttcaatcaagtttatggtcataggtccttgtacattaattgacatgacaaatatatctcactccaattttgatatgaaaaaatattccccccttaattgtccttcaactttctctgtgcatgttgttggcagcaattgtgtctcatggtctatcctccatggtctagagctaaagatacagtggttatttagtacatttacatgggattttgtttctaatattctaatatagctaatcaattcatattaacttggcttttgcgttagaggataagaaaagtggagaataggttcatctcaatttctggctctcagtgactggtagttaacctcctggagcactaccttgagaggattctgaggcttcatctgggttgagtggaagtagaatagaaatatgtctattgatgatgaatgccatctgctgggaaaggagggtagaggcacatatttgccaacatggctctaagaaatgggagagctgctatccagttgtgtctgaaaagattaactggcagctagaaacttttaaaactacccattgactagttctatctcggagaactacaccccctacttgccagttcatgtcttatgtctctgcctgggtctgtctatgtcaagttcttatttgttaacttagtagaagcttagtggactctgtgaaaatgataaagcttgaaagagcaagcctgtgatagactgtgatagactgagcctttatagtatccttaatgctctagaaacttgattgactggaaactttttctttttctttctttctttctttttttttgagatggagtctcactctgtcacccaggctggaatgcagtggcacaatctctgccacctgggttcaagcgattctcctgcttcagcctcccgagtagctgggattacaggcatccaccaccatgcctggctaatttttgtacttttagtagggacggggtttcaccatcttggccagcctggtcttgaactcctgaccttgttatccacctgcctcggcctcccaaagtgttgggattacaggcgtgagccactgcgcccggcctggaaattttttctataagatacacaaatacattgcagcctgttcctgatcagccatttaagtggaataaaagtcctaagaaagttcttcttgagaagaataaaattgagacctccactctgaacaggcatggagcattcaataaggcaaagggtcagaaatcttgcttaacttcttactgttcacatctgtaactgggcataaacctataggatcattttcctttcacaaagaatccatcaaataaatacttgttaaagcctacgcttaacttgagcaccggtagtaatgactcgcattatcagcggggcttttgggcttgcactcatggctctgtgattcatgagggcagaaaaactgactggcttacagctgtctctctttttctggctggcctgcctgcatgcctagataactgaatggcttttttcagaatgaggtatggtctaaggattttgctacttcaacgtcagtttcctggatcttttcttctactccagcttgccatatgtcccttttatattttcttggccactctcttacaaatagggccatagatcagagatggtggccccatctggtgaaatctagctttcagatacgctttgtttgacccatagagtgttggatcacatagaatttttaaaaattaattaactgtcaacattgtactattgatttcaactttatctggagtctttttaacttttattttgagctctagaacttggacattttctggctcctgccttgcaagtctgaacctcagttccagttttctatttttggtgcttagtgtttttgtctttggcagatcctgaccactgttaacaaaatataaagcatgaaaatggtggcatccatgcgatgcagcagttgggactatgagccccaggttggatgtcagctgtatctcagcaggtggagttagtttactgacccctgttagcaagaccagagatgcagatgtgactctggtcatgccagatattaggtttttcagactttgggatctaagaggaccatctgctgccacatttgtgcttggacttcactgttagagtttgatcaatggcatcctgtgatgaaaaatgatgttcatgaatatgaatctaaatctgagcaagtgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttatagccctgcctcttaggcttgacaattggcttagaagttatcctcaagagagaatctttctttttcttttcttattttttttgagatggagtctcagtctgtcacccaggctggagtgtagtggtgcgatatcagctcactgcaacctccacctccggagttcaagtgattctcccactgcaggatcccgagtagctgggattacaggcataccgcaccatacctgctaatttctgtatttttagtagagatggggtttcaccatgttggccatgctggtcttgaactcctggcctcaagtgatccacctgacttggcctcccaaagttctgggattacaggcgaaagcccctttgcccagcctgaatctttccttcttaatgactccatgctatactgtctgttgatttattctggcttttctcagtaaataacaaaattaatagtgatcgccatcacttattgagtgcttatcaagggtcagaaactatgtgaagtacttttatatgtgggaccatcatctcctttatttcttacagtcctatgtggtaagatattatctacattctacagtataagaacataggctgagacaagttaaatatcgtgcccaatgtaacacagttggtaaggtgtccaaaccctggttagggtgtctccaaaggccataatcatgaccatggcactaaactgctacttcaatctaacatctaatttaataaagatatgaacatttgttaagcacctatatagttaggagcaatttcagatgttaaaaggtgtaattcatatttcttgctcataaggtgttcgaaatctattgaaaagacaagacttgtgctgtacaaagataacaaagttgagagagttttaagtgatgagtgagtggagtggacagtttagcggagggagaaatcacagcaggcccaagtcatcagctgcctgagggagagaagggaagtggggcagagacagtgggatgtgtgattccgtggagaccccagaagcaagattctttcacaacacttcttagtcattcttttaccctgagtaggaacgttatgcaataataagattagcccagaagttttatctagaagctgtatcatcctggaagctgaagagaataagttcatttcattattatctattgtcaaaggattaaatttggaagggagataagtatatatttatttttttgcttgttgtgagtaaatgactttgcagttaggtatacagttgaaaagctttattgagatttgtagtcaactctgctccactcatggtaccccaatactggcttctccaccattccatttctccaacttcagaaaatgtccacagcgtccttactttccaacattctccactgatgtggagtggatcattggtgctcaggcctcaagtcacaaacctgtgagtgacatggtcttatccgctgacctggtgttttttattgaagttgtcctctatgcagatagtttaaaaacaagagaaaagaaagaccaggtggtaaacctcctattccttgtcaggagaaatagtgccaagaagccatctgggcactccagggcacatgcccacatcccctcattctttctagttcccttgctggagtgcatagggatggggcatttacaacagaacacgtggaaacacattctcagaaagttgagaacagagtggcctgggataagatggcagagggagagaagaaaatacttctctgagtggggactgtctctaattcttagtttattctcatgcacctgccttctaactcaaataccttggaagaatttgaagtaataagtgcatcatgtagggttagaatactctctctttttccaatcaagtgggttgggcaagagggcagacagcttcctcattggtaggtaataaaaggattctgatttatcagattgtgggatcaccaagtaccagagtagccagggaaattctcaaatggatttgaaaatcctagggaaggagcaccatttagagaggctggagagaagagaaaggcactgcagcctaggaaacccagtgaacaagaatgcagaagcaataacacctgggttcatacagaaacctttgaggtgacccctaagcggggaggtatagacatccattagaaatggattgtgcaggaggggaagggctttgcacatcaagatggacttgggtgtggtttttgtgcgtgactaaggggtttctgctttgtgtgtaggcatggggtacaggagggcctagaaattgccctctctggagcatatccttaccccagtgcagtcagagagataagggctcaagttctgtttatgcatttaatagcctacatgatcttgggcaagtatgtatccctgctgaactccatgtctgtaaaatggggctaatgctacctatttcatttgcttattgtgtatgatataaaacagtgtttgcaaagtacctggcacatggtaggctcttttcttatattgttccggctctcagcttgctttactcctggtattgctcctgtgtgtctctgtattaaagatcatggaggaatataagtatatttttttcctgagagactttgtcttaactttgagattctgtcctcagctgttttactgtctggtctcctaagcatgagtcacgtgtccaaacagcagtctttacaagcccatgggtgggatagtaagaccagcttgtcactgtttgtgactctgcttctgtacctcccagtctgtgtgacatcttcccccatggggagccgtttctactttgtctttaattgctcctcaccgaggcgacttgtcagccaaggctgctttctgtcatttgatgccacatctcttcctatttcagccagccatttggggacattcatttagttgacagtctgattttacagagaacattgtaccagacaataatttgccttgtaagggggtccagcagggtttcctgcctccatgctgacccagggtgccagtacacttctgcgtggctgtggctgtggttctgcacagagcaggtggggaaggtgaagatattaacaatggagagtcccagttgagcatcactgggctacaagtcccttgccctcctgtccttttcctcttggtagataaaccttcacagaacctcaattcaggaccctatccatttccaacagaaccccaacaccatgggagatgaagatataggattatttcttcctaggtttgtgtgccggtttagaattgtctgtgtcctactatgtctaacatcccacttgatcttgacaacagccctgtgagctgggaaagagggacagtttgtggaacagatatcgaggctcttacctttggaataaataaaatgggactcagaagggttattcagctgtcagtgagagtggtgttggctttttattcacaacagtgaaaactccatataaatagacaggtaatttcagggccatggagtagatagagcactcaccctcaaagagcctttgagagaagtctggttatctctgtctggccagtttctggcccttgcttctcttacctatgtcttcagaaatcttcattccggctattcaccttctctcccagtctcagttaggtacccttctcacagaagagttcctcttcactgctcttgtatcttgttaaaaggcttttttttccctcctttttattctgtccccagcctgctgtagcaatgcctgatctctctttctatttattgttccatggagccaaacctccttctgtccctttgggatgacctattgttatacattaataattaacctttactaggaactctagtcacaggcatttaacccaaatgcagaaaaagccaaagtttgtttatgacaaagagttctcacatgctaaggtataatagtgaaggttagaaaggagaagctgacactcattaaacttttatgatttcttttctggtttactcacttgagtgattgcctgaggatcctgcaatatttccctttgcacatggtcagcccagtttagctaaaatgaaaaattcagcttttgaattgtgaagttgagcatgcatgactttccatgtaatgttaaagataagcctcacaggtgctgctagtggggcctggttctgagcatatggaccctggggcccaaatgcctaggttcaagtcctgctctgccacttatcagctgtgtgcctgtgggccggttccctaactgctctctgtgtctgtttctgcatctgtaaaataaggcaatgattacaggtatctcaaatgggtgttgtctgtatctaatgggatggagaggtgttaaatccttaccatggtgcctggtggtaggtgcttaataagtgttagtatcattattttcaatgttattgactatggttaggtccacggtcaaggttacataatagtgagtcattttcaatgcttcgccatagttatatatcactcttgtaatatccattagaatgcaaacagctttgcttgattctctcctggtgatgagagatgggaactaattctacatttaaatattggggattatatgatatgtgctggagtgacccatccaattaactttgtctcacagatatggacagatgaggcttattttagaaattagccattgttgttttggagatgataatgcaaccttttcagggctgtggaaatagcgaaatgagattaacaataaccctccaaatagctgcgacttttgtgcccttatgatattgcattcctaagtgcttcacatgttttaaatcattttattattacaaaataaatagtttgtttattcctatgttcccaatttcaggagaggaaacagactcagaaaatttactttgccaaagtcacatagcttgtaagtagtaaatgtggaattcaaacctaaatctgggtcctgacttagaatttgaataaggtaatataaagaaaataggaaaatagttgggacgctcaatactcagatccttgtctatttcccttccattgttttctgcttattaagtttttatggatacgacattgctcagagatcagagcgccaaaaaccattccagggtactgtatcaaatttcagttcaaataagagtaaaacttttttgaaattctaatttcatggagaaagattaatttctgcttttagatggattatacctggtttagaaagtcataacagatttttttcccataggttattggggttcaggtggtgtttggttacatgaataagttcttaagtggttatttgtgcgattttggtgcactcatcacccaagcagtatacactgcaccctatttgtagtcttttattcctcaccctcatcacacccttcccctcaagtccccaaagtccatgtatcattcttatgcctttgcgtcttcatagcttagctcccacatatcagtgagaacatacaatgttcggttttccattcctgagttacttcacttagaataatagtttccagtcttatccaggtcactgcaaatgccattaattcattcctttttatggctgagtagtattcatatatatatatcacattttcttgatccacttgttgattgatgaacgtttgggttggttccacaattttgcaattggaaattgtgctgctatacacatgcctgtgcaagtatctttttcttataatgacttcttttcctctgggtagatacccagtagtgggattgctggatcaaatggtagttctacttttagttctttaagggatctccacactgttttccatagtggctgttagacagtcataacagatttttttaactgccatcctcacgttctccacctacctacccactctgcaggacagtggccatggctttgcagaagtgtacactaaccttgggtagggcatggaggcagaaagctctgctggacccccttgcaaggtgaattagtatctggttcagtattctttgtaaaatcagactctcaactaaatcaatgtccttgactgactggctgaaatagggcttcagggtgtctcattctaccactgtacagagggcacatgcaatgtgcaaaaaataaaaacaaaaacagacctctgtccccaccagcttttaacacttactcttttctttcaagtaatatatccacatggttgaaaaaaagtctaacactgtaagagggcacagtgaaaagtaagtcaccctcccactccagaatattaatcccgcaaatatactccccaatgacaattttatagttccaaagagactttatgcttactggagcatatatacatataatgcccccacgcccccacacttttacacaatgataacataatgcaccctctatcctgttccttgacaatttcacttaacaatgtgacctggagagcttccacatcaaaaccaaaagcaataccttgtttgcaaggcctgcctaatattccattataacgctgtgccatctgctattgatggtcatttaggttgtttctggtattttactaagggtgcttcagtaaatcactttgtatgaagtatgtgaatccatgcaactcgatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtaggaagaggcaggatgtgtgactgagactagacgaaagctgtagcttctcagtttgttttttggctttatgtttcttaattttcacccttgcatgcttgttgattcttttgctactctctttaatggctgttgtaaaattatgtttctgaaaagatacctgtctcatagatggctcacattctccgcttatctctcttgtcactcactgcgcaattgtctcagtgatagctctacgatcctggagctaaggatggttttacaagtagcatttccactgctaccagagcaactctcatgtcactggtgtgatccgcccccattgccccattctttgcttctctttttcctcatcaccatggaaaccgattgtgacatcacagatgctgcattatgtgattattttgtaggataaacttcactgtgcaagaatttatgcaacaatacacccttcagtaattggcaagagtcatgttgcatggagaaattatgacaagaaaggaaaaggcaaattgatttttcctgaagatacattcaatttaaagccttcctttggtgtaaaagcctatatttcactctttgttcagacctcactaactctctcttcctcttcataaccttttacattttgtttaaatggctttgtttctgcagctgcagatcaaacaagctagccccaggcagtacatagctactatggaatagtaacaaagtgggggtgggggtggggcaaaatagtcaggggtttttgaatgcctggacagtctgcctagctttctatggaccatgtggcaatgaaggtcacattctgtgctatcagaaagggcattttcccaagagcagtaattagagcatttgccatttcagactcatttcctgattctccatttaggtaggatgtactcaagaagggtcttggcttcatgtgccatatttatagagattcactttcctgatgaacattaaaaagtctctatttggatattttctttctaggtacatttggccagtaagagagagcaataagttccccaaaaggctgaaactgggagtgactgagctttggtgggttggcttttctgcataattccaaagctaggctgacggcagagatagcaatattgcccttaggaagagctggatgggttctttgcagagggcagatgggtggcagattgcagccctggctattttattgcccagtaggaatctttactggttgtctgaaatctgatcagaaccaagagccttcaaattaaatgtgctcgttaagcaagaatgaatagtgtctacccttttacacagaaaaacacccaaaaaattaatttctttggaggctaaatcccgccacaccccccatacttcttcttcttcttttctttctccttctctgcttttcagtaaaatgacagcaagagcagagtcagaaagctgttccagaattataaagaaaacactgctgttggtttttaagagcatgtgtttgggatctctgaggttaggtcacggtggacgggttttgtgtctgactaacctagaccttggcacagcataaaagttaccttacccgtgtctcaggcaggctaaaacacacaaaattgccatttgttcatttctgtctgttcctaatacaaatttttctttcaaacaattttgaacaaaggggaacagtttttgttgtttaaaccaccagtggacccaacttcaacaaatatgtttgaatttcagaagtcttaaatttcatacctgggagctaaagcactggctaattcttttctcttttttttttttttttttttttttgagacagagtttctctcttgctgcccaggctggagtgcaatggcgcagtctcggctcactgcaaactctaccttccaggttcaagtgattctcctgccttacctcccaagtagctgggattacaggcaccctccaccaagcccagctaatttttgtctatttagtagagacagggtttcaccatgttggccaggccaatctcgaactcctgacctcagatgatcaacccatctcggcctcccaaagtgctgggattacaggagtaagccactgtgccaggcctggccagttttttgaactactgatgaatttgatcaaagcctattaaaaacttactgagtaaacaaacaattgtcccatgaaagcagtataatctaaaattttaatacagtctgttaaactttcattttttcatgagaatgttttctggtaacttgttttagattataaatctatactaaaggatagttataaaaacaagtgtatctaaatgtggtgcctccttccctgataatcttgaagaataatataacaaacagtgatctagaaaaacttttatgatcactcctcacttgggcaagtcagtcttagaacttgttaagtgcattcaaaactgttatggtcacacattcagagaacagattttcctcaggttgtatttaaggctctaaaatttaaattgattctagtattgtctttacttggcaatagatgtctccccattttagttggtgatcagattagccctgtggacctgtgaggggtaaagaaagaaaactatgcaacagagaaaatagtaagagatagagacctcaacttcctcctttgtaagatagagaaaataataactcctacctcccaatattgttttgaggatcaagtccaaaaatgcacataaaatagttaaaatggtagccaggacattattgttgttatataagtgtttgaaagattgaaaaacaaaaggcaaagcatatttctctaggagtaaacttctaggagggagtagtgaagcagattgttaaattccccttaatatcctttctatgcttctactcttgtgttgactttgcactttatttattgtttttaactttagttaattaattaattaaatttcttgagagctagtctcactctgccacccagcttggagtgcagtggcacgatctcagctctctgcaatccccacctcccgggtccaaggaattctcctgcctcaacctctcgagtagctgggattacaggtgcctgccaccacacctggctaatttttgtatttttagtaaagatggggtttcaccatgttggccaggttggtcttgaactcctgacctcaagtgatctgcccgcctcagcctcccaaagtgctgggattacaggcgtgagccaccacacccagccgactttgtactttaaagtgtatgtttcattcttgatcacgtctgatcttcgcagcccttcaggttatatacccttcataactgaagaaactgagaatcagacagaggtgaaggctgactgatggatggcatgacccatttatcttgataccaataaagcacatcaagaataataaatacctattttaaaatttctgacaggaagtttagatatcacctagtccatttccttaattttccagttcgggaaattgagccataaagtggttcagggattggcctagggtcataaagacatttaggactagaatccctgctctcaaggtcccaggttagcttgtggggtttcatcttctacaatctcatttgatgctgtccaaactccaaccccttcctgggtctgcttagctctctgacttgatctcctgctcaccccctcttgccttctctattctagccacacatctgcctacctcagggcctttgtaggtgccatcccctctgcctggcatgctctctctcctggactttgcatggctgaatccttctcaacattctggtttcagcttcacttttacctgcctagagagaccttcagtgactctacattttaaagtagaatgcatgagtaactagcacaccacccattttactctcttcatagcaactgcccttagctaatttatttcatttattgggttacttattgtattagtctgttctcatgctgctaataaagacaaacccaagactggataatttataaaggaaagatgtttaattgactcactattcagcatggctggggaggcctcaggacacttacaatcatggtggaaggagaagcaaacacgtccttcttcatatggcagcaggagagagagaagtgcagtgccagccagagaaatgccagatacttataaaaccatcagatcttgtgagaactcactcactatcatgagaacaacatggaggtaatgtccccataattcaattcacttcccaccaggtctgtcccacaacatgcagggattatgggaatggcaattcaagataagatttgggtgggaacacagccaaaccatatcatttattttttgtccctctgttctggaacatctgctcaatgagaggagagacatgcctatcaagttcatctcagtgcctagaactataccagagacagaataggtcttccatacacatttattaaatgattaaataaggaataatgtttcagttaaaatgtgtcacagggaatgctcaaaatattcactggcagggctggtagtgaatgcccaatctagagagtaccagtgcatggagagagagacagaagaggaagttccatcttttgggggttggtgagcccttgaagaaaactcaggcaaacatatggaggcctcattctgtctcagtcactcttaaaagcactttgcatatattcactcatttaatcacaccaacctatgaggtggggacagttattttcccattttacaaatgaggaaactgaggcacaggaaggtgaagtcacttcttcacggttatacagctcatacatattagagctggaatttaaatacaggcaggaactgtgctgctctcaacctgtatggtctcagccaagagggttaagtagagaaaagatacactagatgttaggtcactgagatttttctgggtcttcctaagggccagcttgacttagctggcagagattggaaccaaacggcctacattgtcttttccattgtcttgtaacatctaattctcttgcttacattgttctctcctggccagccaatggctgggctcagcactcacctgttaggtttcttacatttggttaagcaactggcagactcacctgagatctgtcttcccaccccaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaaggggtgagtcggcctagaggatggcaagtgagggcctgagtggggctgatgtgttacagttggatccctgggcagcccaagccttcgcacctacctgcactttctttcttccaagagtttttgggtttactgatttccagattgcaccctttctagttctgaatgcttgggtttgtttggctaagactgagttgcagaaagggaagctttataataaatattactgtgattatgatactttttgattaaatattttctatttagagagggtaaataattctcttttgggactccagggggcctagccaactggctgttttattcattcatttgacttgtgattctttagtgctttctacaagctaactcctgggttaggctttagaaatacaatgttgaacaagacaggtacatcgctgtttttatggagcttgctgcctagtggaatatttagccattaaataactgattacaaacatggtgagttttataagaggcagagtgatgtattagttaagaacataaactctggggccagactgggtgagaaatctggccctcatgcagtgatgggaatttcatcatggtagtcaatatctttgaaacttgacttcctcatttgtaaaatagaaatcaggtacctacctcacaagatactgatgatgattaaatgagttaataggttctcgagcatttaatgttagtgattattatagtcataattattctcatcaacatcattaaagagaaggtatagagaagcttgggaggcccttggaaggagacctaacataccatacaggttcactgtatagtgagcaaccctgacagttgaggacctgaacaaagtccagaatggactggatgctttgttcccttctgaaaaatgtccagaatagaattggggaactgttggggtggggaggaggggcatgagaggggaccaaagagatgagggctgaccctgtagactgggccagaatgctgggaggattcccttttcgttcaccacttcagtatctgacatttgcacccgatttacagtttaagtaaagggcatagataaaggcaagaagagggacaacatcaacacaaggagattccagtcaagctatttgcagattgcagcttggtctatttttttatatgccaagcacacagaatcaagctgaatatccgcaggctgtcaacttctatattcaatgaaaggataatttgcatcaggatcaagtttttgctaagggtatagctctagggctttgagaatgctgtacctgtatagttcttgccctcaagaagattatcatttatttagctgaggagttgagacatctatataataagctgtaataagatgatgtaagacagtagcatgttagtggacagaaaagaaggacatggagattcagagacagaagaacgttttgaggagagacctgcagggtctcatctctacagaccagtggccagtggcctatcagaagataggtgatgtggatggatcctgggccaggtctagaacaagggctgaatgaccagttttcaaggcctgtttttttgtaaggccaactgtggggccaactgtgttactagctaaggtatatttcaagagaactacaaaccctttttacagtcagatcagaaatagaatacaggacatgaggacaaaggaagaaaagagagctttcttggagcatatggaattaaaattaaaattcactgaattttcaagtcagcaaccaccagaacaggagctatgataaggaaatactcatctgggacaggaataggccacaaggggctggtcagtctgtcaggtgcctgggctctttccaagtatgtttgtagggtaacctaccctggtgctggttggggaagatagaaaggtcatttttgtctctgagatgcgtgagacagttttggtgtttgccaaagtgttgcagatcttctgttgtctatgaagacagtataaaggtcatctcagacatctcacttcttcttgggtctcctcttaactcaagcaagggccttgtgattgtcagaggcaggacacagtgactgtagccagctgtacaaggtgtctctgagctcacccatttcaagggtgaatcaacgggagttggtccaaaacttgccaagaacagtgaaagtcactgcaccttttacattgtcacttctgactagtcattaaaaggcagctgattggggatatatgagggacaattattcttggtgcagtgcagccaagagtcatccattctggccaaatgagaagaagcttagcaaatttaagatatttgatctatacatcgctcaaatcccagacggttcaactgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttcctgcaggaagttgacatatattgaagccctagtgtgttccaggcactatgtttgaggttggaaatgcaacaaacaaaaaatccaaaacagaaacaccaacttgacacggcctttacttgtgaacaaggggtgtatagtcctcccaggaagcaaaggaaaatgtgagaaatgtttaacatgtggttaatgttatggcagatgtctatagggaaacagtaggacaaacaggcaagaatggccacttctatatggaaggagtgatggcccagagaaggggatccaagctttcttggattttagatttcctatttctaactttaggcatccactctaggcacttctgaagaagaatgaagaaaatgtattgggtattctctctatacaggaatggaatacttttcggattaaggagccctgccccattcaccataacaacatcaacacaatcactcagtttgccattctctctctaatttttattatgtagaagcattctagaatcaagtctaagtctagaatggatcatttgtactaaatgtgttaagcctaagacaattcttaaggctgtgtgtcccagtagctcaaactgtgttctctactggaacttccttgggggtgagtccattggtataactgggcccacacatgaatgggagtgttagaaagaagcacttgtgtatatacactgaagaaagcatagatggaatgctgaaaactggagttttcatggcccaggtcagacactagacactacatcaaaatagaccaatgacccaagcaaagtcagcaacagataaatctaagagacaattcctggatcaaagtcatcagccaagtataagagagtcagagaataaggcctgggaagtagaaagtgtgtatatgatactaagattaatttgcatgtgtatgtttctcttacagtaaaattggataactcctgcttctaccctcataagagtgcttcttctgcctgtgaagatgagctactctaaatcttgatgtctaaaaataggcttgattgatattgtatttagatttttttcagcataatctgttgctattctaagatgtagctgtctctacctatcccaactgtttagctctaattatttttgttggctattcatagtgatgtgagagacgtctccatgacctaaacagcaaaggcctgttttaactacttaattctaatcagataggttgaaattctttagtatcatagaataccacctaccatccagtgaagtcctgttggacagaggaaacagtctagctggtctttagcctgctctggagttagtcctacttaaggagctatgatcacttgacctgggacaacatcttatctttgctggtatagccaaactgtctagttcaattggtgagcatcaagttccagcaaggcaaagccaagggtttgatttatttgtacatcatggagcttaaattttagaccattgctgaatctatgctcttccctgaatggctttttctaaacatatcctggcattcatttggcaagaaagtaaataaagctcagcacaagttcatcccaatgtcaagaaaaataacctacagtacaacatttatctgacatatgcaccagctgaacacgaagaatacaagtatttttacttctctccagtgactcttgttccagtgggaaaggcatgcaggcagcagctgctgctcctctccattcggggcctccctttttaggcaacctcctatgtgatcctgggtagcagcagcagcagcaaaagcaaatgattctgcctggaaagggtgagataccaatcttcgatgaggctggattgtgtcattgaaatgctacatatatgccacatggaaatcatgtcataagaaaatagtagggttggcagaggccaggagtggtggctcatgcctgtaatcccagcactttgggaggctgaggtgggtgggtcacctgaggtcaggagttcaagaccagcctgtccaacatggcaaaaccccgtctctactaaaaatacaaaaattagctgggcttggtggtgcatgcctgcaatcccagctactcaggaggctgaggcatgagaatcacttgaatctgggaggtggaggttgcagtgagccaagatcatgcagttgcactccagcctgggtgacagagtgactccgtctcaagaaaaagaaaagaaaatagtgaaaatagtagggttggcagataccgttagtgttacctgcacctcattcctgttttggtaaatgaggaattggaagccctgagaagttaagtcaacatcagtttagcttggaattgctatagaatggttagaatttatgattcctgattcctaatgcatcaggctttccattacattgagcagcctttccttcatatatactgttatatacatatactagatggttattaaatgtgggagggctccagggtttctgttttaggtctcttcttggcctgcacggttcccttggtgctcttattctttgccacgatattaaaggtcatctatatgttagtgacttccaaattgaggtctcttgcctagaactctccctgaaatctcagattcttatgtccctagttgtctacttgacatctccatttggatatctgatagattaacttaagctacttaattaatagctacttaatacatagctacttaattctaatcagataggttgaaattcttgaatatactggaagagcacctgccaccctgtgaagtcctgttggacttaatcgtatcatggaacagcttaatcatatcattgaaaagcagaaatcttgaggtcttccttcctgccccagacttcttttactttcagtttttccccttcttggtaaatggcatccctactgtccttgggcattttcttttatttttgtcctatgatattcaatctatctcagcaagtctcatccatttctcttataaacccatcctgcatctgtccactctctcttccatctctatcattttagatcaaaccatacttatcacttctttggacaactatatagcatgtagtatatgattatgaaaaatccaaattcattttgtgtcttctttagaatattaaagttaaattattaaaatttctatattctcaacacagtctatcttaaatagctttagtttcagtggcttttggtccagaaaactgtaggaaatgaagctatgatgcttctttggaattaacttcagcattaacatagagattccataaacaggtatttagctcttttctgtgtcaggctttgtgagctgatgaggatatacatttatattaagagaagacacactttctgtcctccacgagctcacagcacagcagaggggatagagacataatctgcaaactctaatgcaatctaccagtgtcaatgattcaggaaataatcacaggaaagaaaaagataacaattagaaagcaagatatgacgcacattttataccattttataattagttctggattcactgaggtcttgctcagactatctcactggtgtgggaataagagaaacctgggcttccaaggtcaaatataataatggtggttgctttcactggtctcagtgctattgaggaggggaatctgcgttatggctgtgccctcatccctcgtaggtttccagatcctttatttaaatgtctgacctggagatggatcctctgacctttcttttctgcaagaataaaatgaggcagttgggtttcacgctctctcaggcccttttcaactctaaaactctgattctcaaatgtcatcagcttggcaatgctttctcttatcccaaggagagagagaaaggtgaatgaagggcagcaatgtgagtccttgttccttacaatccgcagaactgtctggattaggactcggtttagttatatcagcactgcaatcaaattttcatctccctgattcattcatccaagaaaatgaataccttggtgtactgagtacacttcaggtccatcagacctgagttttaattgatggattaacgaatcgaaccttagatttctaaagagcattaaaaggctgtttcctctttggtccattgtttactctttttgatagataatgacatgtatctgagaaaggggcttcccaagaaatgtgcaattcatttacataaatcaaactgtctccttttttttttgtttgtttttttgcttttctgttgttgcttaagtcatacaaatgtatccctggtgacagccaccagcagagcacagattcagcctctttttttttttaacttccggttctgcaagtttccctttccacaagcacagggttttatgattgcagaaagcttttccatagtacatgaaccctagctgagagttattccaccaggtgagagtctgagctacctctgatcacagctggtcctgttactctaaaaaagagtatcaggattgtagattccggttattctagagtcttgaaggtttcgaggtctaagaaggacaggctggggactttggagatcttttaagaatcgacacctgcattcaacctgagaatgtgagggtcagcactttggtgcagtgtgtgacagctgcttatgaaccaacggcacacctgctgctggctgcagtgctgtcaaatgcagggactcggtggccatttacattgccactgtgtatctttattactgtgtgtgctcaaagcagcttaactgccagcagacatctgcccataataatgcaataattgaaatgctgctaaattatgagaaacaagtgctttgaaacacaacacaaggggattgttgcaggcttttctagcatctctggcttcatgtttcttttcacagagagatgaatccttcttcactacagtttggattaagaagaaaggaaagttaaaagacctactatttattgaaaaaaatgatgtgccttctctatgtttggttcttaatatatactgagtcatttaaccctcacatccactctgcagactgcatattattatcctcactttctacgtgaagaaattaagggccacccaattcattctgaatacctactgagtgctacgtgccagggactgtgttgagcacttgggacacaaaggcattgactgtggttctcataaatgtgctattatattctggtatctgagcaattgggacatgagtgtggggagaaatatcatggaaggcatcacagactggtgccactagagctgaggcttggtggagaatcaaagatctccccggcagaccaggcaggggaaaaaaaattccaggcagaaggaacagatgtataaaggtgacttcaataaacagtaagttttccatgtgggtggcatgtagggcttaaagagtgaggaggagggatttgaggggaagttttcgaagatgcagctgtaggggtgacagggccagccagccatgaaacactttgctctcccaacaagtttaggcattatcttataggaagcataccacgtttaacaatgggataaccaggtcagatcactgaggcagaagataaattgaatacagaagacaggagaccaacaggtcagcatataatagtccagtttgcattggtattaattcaggaatgagagataagagccctccctgaagaaacaagagtggaggtcgagttttcgaacatatctgataaataaaaaaggggcaatgtcaataggacttagttagtaatcaattacacacagctaaagaatagctgaaattgaattagagcaagggtttggccatggaagccttttgcttcttcctttcttctgagccatcttgaatcagtgggagattcttaggaggagtggggaggactgtggtgaccattaagcagatgtagctgagagtcaaacctacacctgctttggtcccactcggaacatatgtatttaccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctcatttgggatttatagtgatgacacccgatactgagtattacgtatgtgtctgtgcctagagcacatgtgtatagttttcctctagcttctgagaagttttctgttttatcatgggttctgttttaatcccaccaaggactgttaagaggaaaaagcagcaaacatgtagtaatcaagaatagaagtcccaaacttaaaacctaaaacttgactgacccaacaaaaaccaggcagagtataaagagttgtgtaattacttatcttgccagtagaatagatgctcagatactatctagcaaaaccacccacccccaattttagatgaagaaactgaggcctccaggtgggaaatgagtggtcaatagaatagaatagaatgttcttagtccctcgttttggttcctatttattggctttttcaaagaaatatacatgcatctgtgcatctgtgcatatttgtgaagatatacttttatgtctcatgatcttctaggcagtagtcatgccgttatagcaaagccatttggtaaatctccagtaatttgttctaactgataaattttatttgaaatgttggcaactgatttagagggaggaaatgtggagggaagagatgtatatatttctcttctctttctgtttcatcacttatcccatcttaccccaacaaataacccagcccaacagagaggatactggggtgacaagtacatctggaacttgaggctggacccttcaatatgagtggctcttgaaagacccccttctgtgggctactggacagctatttttctgccaggtagatgcagtctttcttggagaagatcatttcatgcttcttagcatgtttaacctttatagcaagacactcttatcaaaatgacaaaccccaacagagccttctaagaggccagtaaatcagaagcctcatgaaatctgtgcgattagcatgttccccctctttgtttctgcagggtaagaaagccctgtgcatttcagatttcaatcttctctgcaggccccttgtttgaaacctcctgctgtggctcactggtatttaaatactgttttcattcagtcacctggggccacatactgacatcagctaaggctggcacattgtttatctccatcagcaatgttgtaaagaaaagataactgctctgatgtttgtttagttgaattctccccatcctggaaagcatcctttctgggtctgaagatagcagctgattcctaatgtcatcattcctgtagtagctcactgttgctcagcaggatctcatctccagccagttagttgtctctgatctctttgtcccatggctcagtctgtaatgaaactttcacaagcaacctagcatcttcagccactataaggtggagcctccttctgtggaaatccacaaagtcaaggctatattgagagtagaggtagaaggagaaaaaaatgatgaataacagttctgttgtctgtatagatgataaaatatttattagggattgtggggggtgactcttttatcggagtttacacatccatattttcaagttggaaaggacctctgaggtttttgagtctaactcaatatctgatgcatatatacccctggacaaaattcctaaattgctgtgtagagtctataggaatatgtactcttatctacatatgatgtactaaatgcttagcagtggttagcttatttaatctttgcaataactacataagatatgtgctattttcattcttaatttatatctgaggaattggggttaaggataggttaagtaacttgctcaaggtcacccaagaatacgttgaggtgatctctgggtcttccactcctgagtcctctcttctgtgatcgatatactttactactctcagtaacaaggattctcacctcttcatgaagcagccattccatttttggatattactaagtagtctaaaaatcttcctttcactacaactgaagtcccttttttgaaacactctttttattttattttgttcctttttttattatactttaagttctgggatacatgtgcagaacgtgcagtttttttacataggtatacatgtgccatggtggtttgctgcacccatcaacccatcacttacattaggtatttctcctaatgctgtcccttccctagacccccaccccctaacaggcccagtgtgtgatgttcccctccctgtgtccatgtgttctcatttttcaactcccacttatgagtgagaacatgtggtatttggttttctgttcttgtaaacactcttttttaattgtgataaaatacacataacataacatttaccattttagcttttttttttttttttttttgagagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcactaaaaaaaaaaaaaaaaaaaccttcactaggtgcttatcatgccatggatcctagagatgtccagaacaggtcaagctaaaacccttctctacaatagaccttcagttattcaaagacaactatcaggttttccactgaaatgttgtcagtcattctcaggataaacatcactagtttcattaaccagttctcacctattgtggttttaagttccttgctgagttaatccagcagtcattgagagaagtgggggaaggtgggagagggttctgtgttctgaaaggaatgatggcttccagtacttcacaggggtctttgtgaagcaggccatgcccttccaaggagaaagcatgtattgttaatgcagtaactcacatgaatatcagagatagtgacacatatggactatgggtttgtgtagttggcaggattcactggtacatttatggtggtggtggggtgagtgcttttgttagtttcttatcctgtaaaaatgctttgggccaggcacggtggctcacgcctgtaattccagcactgtgggaggccagggcaggtggatcacctgaggtcgggagttcaagaccagcctgaccaacatggggaaaccccatctctcctgaaaattagccaggcatggtggtgcttgcctgtaatcccagctacttgggaggctgagataggagaatcacctaaacccaggaggcagaggttgtggtgagccaagatcgcgccattgtactgcagcctgggcaacaagagcgaaaactccgtctcaaaaaaaaatgctgtgggcccacttcaggtaacatcacatttaccacctcgtcttattcctcaaaatagtcctagattgagtgtgttaagtcacatatctcaaaagcaaagctaaatttatttttgaccataggaacatcttagggtaccactagacaaggaaatcatgattttgacgagtgtcagctgacacaaaatcattgaatgctacagctgggcagggccttaaaaaatcaactattccagtgcttataatttgcaaagaaataactgagattcaaagtgattatataacttgcccaaagttacagaggtagtaagtagccacgctgggacttatcactcagtattttgaatccttgatgagatctgtctattctaaagcaatttcagaggtgctcttgctttgtacctttgggctggtcctttgtagctgagagtaagatgctcctgctgtgtgggtcagaagatttcttcacaagctcagtgggtccttgtgattttttttaacatgtaatcgtccctttatttattgcaaataagcttggcaatttatttagttagcaacttatggtctggaaaatctcattatccaaaccttacattatcaacacatctgtttaaaaagagatgcttaaagaagtggtctaaatatgcagattcctgatcatcttgaagaagggaactactaaaagggcaacctgggagggagtagacaattgtagtgaggccatgaaagccactgacattcacacataagggagtataaaaagggaattcacatttattgagtacctgcatgtgccaggtataatttggtccttaaataagatgaaccaggtttggagtcagacaaaactggatttgtgggggcggtggggaggtgcacagtggctcatgcctgtaatcccagtgctttgggagatagaggtgggcggatcacgaggtcatgagttcgagaccagcctggccaacatagtgaaaaccccgtctctactaaaaataccaaaaaaattagccaggcatggtggcaggtgcctgtaatcccacttctcaggaggctgaggcaggagaatcgcatgaacccaggaggcggaggttgcagtgagctgagactgcaccactgcactccagcctgggcaacagagggagactccatctcaaaaacaaacaaacaaacaacaacaaaaagctggatttgaatcccagttccattgctcactattatgtgatcttggatgtgtttttaacccctttttagcctcagttttctgatccatcaaaaagccattctggggttgttatgatgcttcaataacataattgtgtaaaaatcttggcaaaatgcctataattttgtaagtgttcagtacatggaggagtattattattcttctctcttttaatttttagagcagatcttataaagtttgtggtatcattcagatttttagatacttaaaccaaggatcagaaaactaaaataaatttccatagtcgcaatgttagcaaatactaaaggtaggaatttttcacccagtctatcagattttctattattctttgccattcatttaaacaggaggccttagaggtgggattaggtactgtgggagggagagagagctgtaagaaatgagatggctttttttgttcctcttccaaccttgtcagttctctgctttaggactttccaaggggcaaacatgagaaatacattgggatggaagctgtccatttggagtaaattcaggattgagaaaagcagtcaggatcttccacatcttttcattcacactgtttgttcctaggtggtggagaagaactgtaaagtttcatggggctggtccagaagagcatgaaatgagtacagctcaaaacttttggctcatcataatttatccagggctgcaaaataccctaactcatacctgcatatttacccacatgtacaaacacacacacatgcacatgcacacacatgcacatgaatgcacagacacaaattcttcggccataaacctggacctctctaatttttgctttgctcatctctccttctctagacggggagccatcggctatgtatccccagtgccaaggaaaaggagctcaatctgtgtttgtggaggaacaaatgaaagaatgaatgcaaagcaaaatgaatgggattatttctaaagttaactatagttagaattctggtttattatctgacaaatttgaaggaacttagtacctgctagacatctaaactgcccaccctcacccccaataacaagttaggattttcgtagttggagatgtgcctagagaaaaataatgagaagctcccctaggctggggcctagcctcttgggcctgtagcaactattcctgtaactcagtattagctatagagcggcaagattcagtgttgcttaaagtggacaggtgggcaggcatggaatgaatgaatctggaatagagcgagaagcaggcttatgcatctgaggcaggcatttctaccatctaaaacaatggggtgactttgcagctctccttggtgaaaagagcacttcgtggatgatacccttttgttccccctcactccctttttattcacccctctcctgtcctgcttaccttttctttttcctgtttcctcttctttatcccccctattcttcattatttttttccctgataaaccccacacagtcctttcttcatttctatttatcgtttaagcttgatgcagcaataatgtctattgtttaaagggcttttccctcccagagggatgagattgacccttatttattcagaatgacttgactcagggctgttataaaatgtgggctgcacaaaactgcaaggtggctggtgcctaccagctacctagataagtggtatctggttgaaggggaggacaggcccctaaggcctctttgagcacattgtctaacctggaagtcatctccttttgaaccacaataaatgagaaatggtcttagcaagacaaaacaatgactataaaaccaggtggctaaaatatggctgaggaatgcagaagagtgcactggtatatcaatctctaattggggaaatgatttggctgcagcacaaaggagcccctctctgtctaacattgggtttgccccttgagctttctgcaggcggagattgatggtggtggcgtgatggtcaaggaatgtgtcctcagatgaggctgagcagaattatttctttgtaaattttctttttcccctttcttcctccctcccttcagatatctcactttctcacctttctttcaccttccttcttttcttgcctgtgatcctttcaaaccactttagtttttttcttatgtggagaacatggttgacccattcaatttcttttcactacagagtagcgttcctgggggctttgatgggacaattgatataatgaatcttgactttggtaggactgttattctgtcttcataaaatgctactcaataaaccagtctctagattatagctctgttaggagtgtttatcactgttgaaaagaagccttataaaaattgtcatctgtgggttattgctaacattatagattatgaatctccatttaaaaaaataaacactgatttttataattctaaaattaatatatatttactgtagaaaatttggcacatggaagtttattaattcaacttattctttggccgacattaactgagtacctgaatacaaaacctgtggtggttctacaaaacgcatttcatgataaacaaaaataaatataattgagcataactgtaccaagcagaaatggttattattaacatatctgtatgctttattctattattttgggaatgtgtatatatatatgtgtgtgtgtgtgtgtgtgtctctgtgtgtgtgtgtgtgtattctattcttgaatatatactatttgtgaatacatatattctattctatatatatattatttgggagatatatgtgtatatatataacatgttaatgtaattttataagtaattattctaatttttccagttcctgttttttttcaaaaattatctcgtagttgcataat[450 bp omitted]cactatacccactctagtggaagggactgcaaagtcacaagcaaaggctgtgggtatataattcagaaacaggggaggtgcaactaattatgaacaataaaacagtctactatagtagactacctgatattttgttatcactaatgtccataggttgatccaagaagactagttttttatcctttctgttaacctctaatgtgccccaatattgataaatgccatgagacctttttccaaacacataggcttcagaagacatcagagtcttctccactgcccattttctgtttggtggttctaatgtatcttcccattgatacttcaactcatcatatctctaggagttttatttcttgcttcacagaagtctcttagaccaggtaagaaactagctctgattttaatgcagagaatgcttatgaccattattttagatgggcttaaaacaatgaagcctgagacctaaaagggccagttccagaaaatcattagcttcaaaatctagacatgagagaaaggttagatggtttgaggatggttctacaaaatataatggagggaggccagaaaaggttagtgggataaggttctcagacacttggattctctaggagcagtaaggaatgaatttagttttttgctttttggaaaatttagaattactgaaatttgctcaagtctgggattctttttctacttgaggttttctcagggctttgaagaatatgcactgcatagggttttggtattcaggcttcattatttttggttccattctttgtaacacctggggtcctggttctctgctgatgggcctcttaattttgtttattttgtgtctgaacctcagattttagtttgtatttattttttgaaataataatctggttactgaattagacaccaagctcatggaaagcttggaccatgcctgctgcactattttctgcctcatgcctgggatatagaacgtgctcaacacattgttgttgacggtgataggttcagggcacaggtatcctgtatcctcagtctttgcatccaaaacttgacaaatccttttctcacccatatattctccctctcatgcaaaccttcttactttagacttatattttgtgtttaacagtcaaacatttcctctaggatgcctagtctatgtagccatttcaaagataattttctaaggaagaaatgcgaccatccaagcaaagtgtactaatgtcaaggaatcagtgagtgctagaaaagccaattcagagtggtcagaggtaacaaggagactaactaaattgattagctttaataacttgtattgtctcccagagagaaaatattcctggccagaattttgtcaggagcttgttgctctaagtcaactatattgcatgaggactcagagagtaagtgtgcaggaaaggagaaatttatttgggaagattttgtagtggaagggatactatgtaaggctaatattacagaatgttagcagaaagccatctgttaccactgtggtttactaccattcagagagtatttattgagaccgtattatatgacatgcactatgataagaagaaggggtacaaaggctagccttcaaggagctcaaggtcaccctaagaataacaggtggctgcctccaggaagatggattgaacatgaagtctattgaacaaagaccctgctcttactgttgcatgaatgaccttgtttaagatgcaagattgactgtagatggcagaggagggggaaagagaataggcctaaatctcagtcagaatagaacttcaatttctccactctcgaatgcagtgagcatagtaagacttttctctactgaggcaaagaaactttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagataccatgctagtccttgagaggtacaatggtgggcaaaatgtgatgcatctttggcctcatggagtttatagtctagtgacaggagaaagacatttaccaagtaatcaacaactaaacatgcaatttcaaacttttgaacttgagaagtatggagagccagccctagttgaggggtgatcagggaaacagctccagagggaatgatgcttgacttgacatttgaagaataagaaggtgttaccagacaaagatggatgcagtcttctaggcagaaggttgttacaaagcccaataggtaaaaagaagtatggcaagttagagttcaaggaacagagggtaagtcaggttggagcacagaaggtggaagtggggaggagagggaagaggagacagggcttggtcatgtcatcacctactggtagagtatgatactgatttagaatttatcctaaaagtaatggcagacccttgaacagctataagcaggagaataacatgaccagatttgcttttttaaaggtcatcttggctgtaggacagtgagtggattggagaagcataagaatagatgttaaaatactagttctccaggaaagagttgacagtggactaaatttggactagggcattgaccagggatgtgaagggaagtcggtgaatttgagatatttatagaagatcctatatttgtagcacttgagatgtcaaagaaaaacaaatcaggacttagtaagaagagatttttattcaaaacaattcttgtaagagaaagaaaaggacaattgcaaaacggagaatgctataacaataaagtttgcaaacatctcaatatcaaacagaaacaaaaatgtttttctttcatagggtaaaggaggaggctagcagagataagcagaatctttggggtgggaggaagctggacaaacaaggggaaataacccctggagtctgacaggacagagggtcttgctgtcaccagctgattcccaggagaagctggtaagcaggtacatgttccccttttatgtgtgtgctcagactttgggacaagcagtgttcaggaacctgtagaaatgactgaagtttggttaaggcaaaacagaaggatgagcaattgtgaacactaggttagagaatgtaattcaccatgacctaaaagatgacttcaaagggatcaagcaggagaggtagaatcttctcagtggatcagtcaattcttatcctcttctctctaggggacagttgatatctttaattcatattaggggtttgttttaggggtttcaaagtcttctcacatccttgagttcatttaccttcacaaattcagagaagtctgttagaattgaaagacctaagttagaagtcagttttctagtcttgttattttacatatgaggaaaacacagtctagagagggaaatgtatctaagacatccccattagatggaaaactgtgaccagcacccaggacttccaacatccagtctgggaatgattcctcctttatatggccgtttcctatctgagaattctcatgacattctcatgacacttcagtgtagcactgtagattcctcccatggagcaaactaaggtgctttccacccaccctatcccctatacagctacacacatagatatttactacacacatacacatagatccatgtatcttattctgaaagctgccagatgtcaatttgaaatttaatttaattggttccttgagttttcggttccccatcatcctgctccacctttcgcttagcgtggccatcctggagttcaagatgtagttaaaaggcaagatggtgtgatggatagactgtaggttttggtggcaggcagaattggtttgaaagcctaatagctacatcatcgaagtgaaattatttaagttttctgagccttatatttttttcactcatagggctggataattgtaattgtctcacttgattcttgcaactattaggtgagggtataataatattagccaccattttattgggcatgtactatgtgccagacattgcacaacatgcttaaaggacattgccccatttaatccttatgccataacctgatgaggtgggtaatattaaccctactttaaaatgcttaagagttcccaactctaatagtaataaggactattattcccacaatcatttatttacacttttattcattcacttattattatgaagtgcctattctgtttcaggcattcttctgggtactagggatacagagaataaaaaactgacaaagcttcttgcccccatgcaactaacaatctagtgaggagaaataaaaaataagcagaatacagtaaaatatatgtagcttattagataaatgttcaggacaaaaataaaatagagcaaggggatggagaagagccaggatattgctgtgtgtagtgtagggaggtcatggatgtgaccatcgattgaaaatatattttatcatttcagaaaagacttcctggtagattacatgaactgttaagttaatttgctttttgggaaaatttagcacttggtatatcctctcattcttccctttccccttcctccttcccttcctctcttaatgcctcacacatttgtgatattggctgtgttagttgctgagaatgtaaagaggaatgtttcttttatctgcttgtctacctaccgttcttcctacttaatcccctatttgttccacaaaggattaagacacatacaaacaaataggaatggtccagccttctaattcctctgctcgggctgtgcccatctgctgggggtgatttgggatttggaagctgaactgtcctattggtacccaaaggtaccagtaggggtccaaacacagttcccaagtgcactataggaaatccggatagagttggccctaaggcaccttaccctgcaccccaagatgaacactaaaaatctgttcagctcattaaggggcctcccagcagggtggctccagtctgtgatctttgcagagcaaagtgatgggtgccctcattactgatgtagtaggctcttgacccgtgagctgcagctgcacacagacagctctgctgcccaacacactctcatcccagtcctcaggtggaggagggatagagtttactgggaaatggcaaaaaagggggggaggggtagaaatgggaacattttcaaattaatttcagaaatccagtcttagctctaaacgacagctgtgagtttaatcactgaaactctctttctattcaagagcagcatgtgtctcctgaggagggggagcattatcaagcagttaagtcgttggaagctgcttaggggctggtaggcagtctgcagggaaggggaggatggcttcgcttttggcagtgacctgggtatagtaggtactgcttacctgctatcatctcatgctatctccagcagtccctgaggattgctctgctctgtctatcactgcgcggggtgggaggtaacatcttgtacaacggaagccaatggggccaagaaaacccatgcctcagcatcgggctaaaaaagttaatggatttcttgattttaagggttggggattcaggagggaattttcctttccatctgttaccaccacagcagtaacagcaactgcaactacaacacactccaccaactacaagagctaatgcttatggagcacttcctaactccctaaacattcacgtcttcgttcatttatgatttactgagcatcgactatgtgccatacattgtgctaagcactgggaatagagcaggagctaaggcaggtatcatccttccccttaaggagccagcagtttagtggaaaagactaaatgggcatctgatgaactcaaacctggtccccaaagatgtcagctcacccgttcgaggaatgagtctcagccttggtccgtcacttccagcctaggtgggggaatgtcagctgatatgaaagctttaccctcccctcccatttacctctcagaccccaccctcaggacagtggtatctgtccgtggctcccatctgtgtgttgctgcccatcacttcagaggaaccagaagcacctgccagagagctttatgtcatcagccatgggaacttcttccatgctgtttgttgcactggcctattttagggaaaactctacgcatgaagagggaagctgaaaagacacagggcaaaaagaaatattccccaccccattctttttccccactatgattttcttcttctttgtcttttgttttatctattttatgattttgcttttcattttaacactgtggtgaggggtgggggggtgctttaaaaccagagccacaagcaaacaggaattagatcagggaaataagaaggcagatggaagaatgatttttgagtaaagcccaggcccagtggaatctgccttgaccatgtggtgctcgtgtgggcccacagaaaaaaacccagaacattgcagtagcaaagtgaaagctctgtggactgtgaatgcagattagaattaaaagatgtgcttaccacactgtctctgtctctgtcccagagcctgcctgtgaacgccaagcctccactctcttccccagatcctattctccgtcataagttctccatcacacattctcacctcttccatttgagtctggattaacacagtagatgctgctcttttttgtcatttttcctctaccatgaccaagaatagtagtttaggcaaataaagatactttcttcctacatatcaagaagttccaagcgaggcagcccagagctggtaacagcccaacaatgccgctatggaatatagtccatattttgctccaccacacatagcatgttggctgcgatcctcaggtttgttaccttatggttacaatatggttcccacacatccaggcatcataacctctttacaggctggaggaagaagaaagcacaaagaactttggttgccctccacagagccttgggtactctttcacagacaactctttatatcttgttttattttttgagacggagtttcattgttgatgcggctggagtaaaatggcgcgatcttggctcactgaaacctccgcctcccgggttcaagcgattctcctgcttcagcctcctgagtagctgggattacaggtgcctgccaccatgcctgggtatttttgtattttttagtagagatggggtttcgctatgttggccaggctgctctcgaacccctgacctcaggtgatccaaagtgttgggattgcaggtgtgagccaccacatccagccatctccttgtatcttatgttcccatcccaaaaccaatcactggaggaagggatacaattaccaggcctggtgtggaccaatcatgcttcatcttctgatcttctgtgggtgtggtaggggcctactttctctcagaacaagggctttctaaccctaccttaacaaaccaggcttctgtggtcagagcagaaggggaagcaatgtagttgataagcaatgagcaatgggtgccacttgcctttgaggtcctccttttgcctaggttgggtgccctggcatctcttaagttgggggtggatgtgagagagttatctctttatgccaatattaataattttgatgttcaaaagaagcccacatgcagtttctgacattatgttccacttttaaactctcagagccctagtctctgaattagaattctagttttagaagtttttctgggcttgcttttctattagaaaccatttggttttgtggccttgtttgaaggcaccattgctcactggttaaactgactccatttgcctgaatgattatcgcctgatgtcttgaggcttacagacccagagaaacctttattcttttctcgtaacagttaataataaagcacttgttcccttgtctccttttttttttctgccacagtatttctcaacctactatctttccatcttttgtcagctagtagtaaaattcttctaaaagacacccaagttcaccactgtcctcactttcaacatatagtagagcactttaatttgcaatttttttcttctcttttcttttcttttttttttttttacacattagccattaaccctgcaccactgccctccacatctttgtcttctacatgaaacttctgtaaaaaatgtctgttaacacctagtgttcttctcctggataatgaggaccaaagaataacccaagttctctttgcatgttggcttgcaggaaacttagagttgaaatacacagctcaatcttataaaatcttatgccctaattatcagtgataattttcttctctgagacagtatcttatatctgaatttatattttttctggttatgacttttttttcttttggttagctctgatattttaatttaatatgttttcagtaaacatataaaatcttttgtcaaataaaacaatgtatttaaaagaaaatagctctgtgcagtgggctttgctgttcttattttacatgttaggatattggggaaactaaaagtcagaggtggccaagatgttttcctattaggtacctactctggctgattggcaaatttcaccctggcatgttaggtagagaaaccttgagaatctgcatccctcactgggatagagatgtagttatcaattagcagtgactgttgtaggtttcatggaaagaggagaagtgtgatatctttcaaggacacaattttcctccagaaaatccaggaatcctcattttatatccatgctgaaggctcctagagtagcattcctcctcttccctccctctccctctttttttgctgtaacaacacgtggggagatatgatggaagcgaagaacgaagtggactcttcagctcaatggaaaggcatcaacacttcatttgatttggaagccaaagaagcaaactatgaaaacctcaccagcattgcaagggagtgatagaaatatataactcacaaatcattatagcttctcaacgtctcagtttttaaatttttactgtgtatttttttgttttgaatcactttattgaggtatgactggcatacaaaaagcagaacctatttaatgcatacaacttgatgagtttgagaaaagtacgtactcatgaaaagcatatgttcatgaaagcatcaccacatatctatcacgtcccacccttttatttattattatttttgcaataagaacacttaagatatactctcttagcatatttctaagtatactgtacggtattgttaaccaaaggccactatcgtgtacagtggatctctaggacttattcatcttgtataaccaaaacttggtacccttggactcagctttttttctgaatgataggttagatgctaatttgcctgcggtgcctacagaagttatcagtgacataggggaagataatcttccccagcctttctcccctgtctagtgttcaaattgtaaaattttcttgaactggactaaatgccttaaaaccctggaatgttggtgtctttgaacccttactttgagctctatggagacctagattgtccctggaggtagtgcagcctcatttcaacaaatcaggttgtcaaaatggctaattgtttcctcgcattactctccctgagaattacctttcttagctggcttcccacggaaactaatggtatttggcaactgtctacttccaaatcttcctctagaatattgcaagaatgtctgaaagcacaacatttttggacaggccaagatgccatgggagaaaacacacacacaagcctacgtgctttctccaaaacttggctctgaagacagtcatatggcagtcacaccacaatccaatgaattgttttacctcaggttttggaagtttcactgctcccaatagcttgcattaagccctaaataataataatgaggaaattctattaagaactatttcagaagctagagaatgtaatgattataaataagaaagggaataagccatatcaattgctgcatgtatattgtataaatagcttgttttgcttaagcattagttaagcaacattaaatttaaagagtgtttctattagccaaaggtatgtagtgtgtgatatagaatgattcttggaactttgaccagattttctgtctgggatgggagaaaatctggccagagtgtgtcttgtaggttgatcacaaattcctaatgttcatcaagagtggaattttgacggtataatgaaagcctattttaactatgtaatactattcttattccattatgtaggtaatgaaagtttgtatgtaaataaaagtttaagcttctctttataataatttatcacaggaactgcctgcaaatagattctaacgataagaatgttcttcttttagctataaatccttagttttctacttcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaaatgattatagcctctcaaagcctcagtttttatttttttgaaaaatatgtaagatactactttatctactttgttcatagtagttattgctgacatgggacaagatgatctttatgctctatttggtgtttgaattatagaatgcttcatgaattggattaattaatgtaaagtttttgaatgttggtgtttgtttaatcagtattctataatactgccaatctcttactccttgctatccacatatcttcctgggtgatctctttcgcttgcacagagtcaacttttgtctgcctggataactccaaattctattccttttgtgcagaatttcccatgagcattaggcacacatagctcattgcttgcctgacatttctaactggatatttcataatcaactctaaatctacatgcccaaaagataactcttatcacatatcagggtatcaaaactagatatctgggagccatccttagctgaacatagtttcttaagaccaaggcacaaaatatttgtgtagaggagacatggggcaaaggagagaagaaaagcaagaacgaggttgtaaagaaccttgtatgccgagtaggaaatgttcatctttattccgaaggcaatggagggatccttcattgaaagccttctgagcaagggtgtaacatggtcagatttaagtcttattaagattgttctaggatcatctaggggatacagtgaagagaactttactgaattcaggcaaggcaaagagaaagctattgcagtcaacctagcattcaaagagaacactccattgtggacaataaaatcctggttgtttaggtctaaactttggccttggaagggctttttatataatctagtaaattttcctttaccaacaaagtaacagatactccagaagtttttaagcttgcccaaagtgactcagctggcagatggcaagtaccaggctgatatcctgcaggttttttgtttgtttgtttgaaatggaggagtctcactctgccacctaggctggagtgcagtgacgcgatctcagttcactgcagcctccgcctcccgggttcaaggaattctcctgcctgtctcctgagtagctgggattacagcatacctggctattttttgtgtttctagtagaggcggggtttcgccatgttggccaggctggtcttgaattcctgacctaaggcgatccacccgcctcggccttccaaagtgctgggattacaggtgtgagccatgtctcccggcctgatatcctgcagttttgagatacagttttgtgtgtttgccttggagaaaaagagaatttcagttgcccacgattcatacatttttatgtggcagcttccttgaaagggaacaaacgttgaagggattcatttggcaacattattcccattttatagatgtgggtttttaggcttgaggaggttgtgacttttctaaagtcatgtaattaattagtggcgaaggtgttatttaatgacagcatctctcaatatccacttccacacctttttttaatgacgctgcactaaggcaagtgcctcctctgggatagtttctgctctgttcactgctataactgcacagaggcctgcagtttgaatgaagatacacacagagataactgaagtttcaactaggaaagggcaactggggcatgtaggggcaagtgtcaactaggaaagggcaactgggtcaccttaccatgatgacttcttcatggtttcagcctggacagcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcgagtgtcttgatgtgtcaaaatgggagtccctgaacacggaggaaattcacaacatcctaagcaattgtaacagatgaccttatctaatgagaactggggaagtcctctccttttagggaaagtgaaaaatgtgaactaaataggactttctgtaggagagatgcctaaccacccatgggcatgctcacttctacttgtgcagagagtttgcacaaccccatctcatttggtcctcacatcttctttgtattcattcactcagctaggaaggggaatggaagaacacattctccaagagtagtgcctttgcaacatatttttcaagtaaagtgttgacacaatttttgttaagactatgatgaaaagacaattgagaaagaattgtgaaagccagatcttgacatatgcataaaagtacatggatgcctggctctgggctgattaatgatctgtggttgttaaaatctagttatgcctccacttgggaggagtaggtaagctcccagggcaggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgtaggtcaatttcttaacctctctaagcctcagttttctcatccttgatgtggggatcataaatttacttcttacgaagatgaaatgaaataatatatgtaagcagtgtgttcaataattgttagttcctttgcccttcctattttctcaccaaggaaatcaggtgcaataagctttagtgatctgctaaggctagataactggtaaatagtgaaagaagagtgaggagtcaacagatgattctgcttcttatttcacgtgctttagtggtatttacagagccctggtgcaagagtttctctttgtacttagagaagttgattttctttttcctaatttcttcttatttgaactaagaaccctctacttctctccatcccatctgtattttttctgatgagttctgtagaatatgatattgcattcaagcttcatcatacttttggtagcgcctttgcttgctacatgataactgtcattttagctgcaatttttcaaaaatctcctaaaacactcttctcacacaatcggcctctcttaactaacttgtagacaattttgcccttctgctcaagatcttttctgcctcctttagatttcctccctatccatttctgtctcttctccctatgccttgatctaaagcttttgtgcattatgggactttctccgaatccattttgtagtcattcactcatgtaggataaatgcattttttaaagcactttcattttcattttacatgaaagagaacacttgggtactggtgaaatgcttaggtcagcaatccttttgggaagatacacatgaggggtattatgtatctcgtctttccctctttcaacattttctaattcaattctatataataaatatttactgagtatctactctctgctgggtattgtgctaggttcaggggatatataactgaatcagacagaacccctttctttacagagcatatatgatgatgtcatctcaaggggagcccaggatttcaggtcacctatgtataaagtgagaaataaaggctggctaggagtcagccatgggaaggggatagaataagttgaacattcatggtaaagagaatactgtattcaagatcctaaagcataatatgttggaaaacagaaaatacagtatggccagaaggcagaactcaaaggagaatgagagccagcggatgcggtaggaaatgtggggaagggtagataaagaagttagggggtttattctcaagacaatgagaaattattgaaagagctaaatgaggaattggtataatatgaaatttaaaaaaattatcctaattgcagtggtcagatgggacaggaggcaggcagcaagtggagaaacagaagacacacagtaaaggagccaacctagactcagtggtaacagagatagcgataagtgaacagatgagaaagatctgggtttagaaatggcaggacatgctgatgattgagctatagaggaagaggaaaagaggggagtcaaatacctgtctatgcactgttcataggagatttaatctagtcaactgttttgagctaaaatgtgaaaatacaaatgccatggccagagcaaccataactattaattagcagcaacccttggcaccttcacccaaagcaatcactatgctgggaatatcagactctgcagtagaaccaaatccaggacatccgtgtacagcctactcacatcacagcatctaactgtgttcacataaaaggcagtgtgaggcataacgacccaactcagaaatgccttttttttctggatgttcttttcctcacaaaacatcaaataagagagtctggccacattctgatgatttctcttagaaacttagagaaggggagaacaataatttcctaaggaagtgaaccaattgaattgtcagatgggctgagcagtgacttcttcctggctctactgtgggcctcctgatggatggacatgggccctgtggtaaagagatggttctagaaatgcacagaaactatcgattccaagttgacaaatgagaaacaaatccaatctcaccagccaatcgggactcatcattttgccaaaacaatgcccatagattgcctaccactattattaagaaaagcttttatgctcatttcaccttcagtgcccttgatccaaggtctcagatttatcctagtttcattttcagtgaagtattgatttgataaaagaaacgagtcctgctgctgattgcttagacacttgttagtttcacctgcatatgtaaggtggagttggctgtagttcaagcaatagaaagaagaggtactattttaacaacagttttcaaatctgaagctgatgttctggaaaaattagagccatcggtttattttattgtttcatttataatctcagtgtgcatgtatcttaattctttgggaatagagaaatggcttcagagaggctggctgaatggggaggcagaaacatccaactctgtccctctgggcttctatctccctggggttcctttcacttttcctccaactttgtttctttaggccctggagctaatgcaggaattgccaaaaacatacctatgtggcacacaggtcctgcatgttcttgttctagtaagtggtgtgaatgtgctgtctctagaattatcttgtcctgtctcatcaagaaaatcccctgcagatgtgaaaccctcaagcaattttctctatctgaagatcaggctgcattatttatttatagttccttcagcctccaaaagccctggctgaccctcagtctttgagaacagcacctctgtaaacagatgaaagggattccctgtctggaatgtcatggaaggttccatgaatctagcttccgctaataccaaccattctagaggataaagcccaccactgcaaaagtgtgatccagcctcacacactgccttgcaaatattcttcaggccaactgatgggtgaaggccaggtttgagaacagcacctttgtagcccatgaagtttcttgacacatttagcctcaaacacttgcagagcagatatagtcgatatatcctgggttcatgaatgacaaaacttttcttcatgctgaaaggccaatcataggaacctcaagtttggaggaagtcgcaaacgtaggagagtaggtgatcttgttatgcttaatatctagtgtgatgctggaggaaagacagccaaattggaaagttggggtgagataggatgtgtcttttccatatgtttaaaggatagtatgctgacaagatattattaaggctacaataaggcaattgaggaagctgtatgtcaataaggtcttgagatactcagagagattagacaaagcagagtaatattttcacctgcttaccctcctcttcccccaaaccataccaatgaacaacatgggccccagccctaaattcacaatctctgatgtaagagcctgactaagcatactggcattaaacataaggatgtttgtgtaggcaaaaacccccaaacaattattttagttatctcaccatgttttcatgtctgtttatgaagactcaggcttcctaggctctctgagggccagaggtctcagagctcaggaggtaactagcattggcccttcctttagtttctctttgatagcttattacttaaggaccccaggggaacagtttcccagaattctaccatgacaatttcacaatattgaaaatatattaaactgacattaacactgacatgcataattcctaccaaagcggggaggccgttttgtcatgcggcttaggtggaggagagatagtaagagctgttaggctctctgaagcctcttagataaaagaagtccttagctttgactataataccagctatgctcaagcctttttccccccactatattctttacaatttcacagttaatctctgcattatggttctctgtagccagaagacattgcagacagggaattgagaggatgcttgagttaatctgcagggtctaaggtggtaaaggcaattcagctaccctcatagcatccccgatgttccgaagaaaggaagcagagcatatgttttacatggggataaattctctttatagctaattaattacaaattgccccccagtgtggtgatgtgcacttggggatagattaactcaggggaggagtccagctgctaattcttttttttctccctccctgtccctccttgtgctcccctcctccttgctccctatttcttggaggctgtgtctcctatcgctctgtttgtacagctagcgctaatctaaaatcacagttattagatcacattaagctcctcaaagtgggtgaagcatctgtgagtgtctcattaagtcctggacacacatagtcttgccacccctctctaattaagagattcccactcttccagcactgctgactgcttcctaaagaaagtgtgcctgccctggaggggacggaagggggaaggagtgaggtaaagtaagggtgagtcttctccatagaccgtgaccttgcccagcagtgtggcctgctggaggagcagcagtagcacctgggagcttgttagaaatgcaaaatctgagccccatctcagacctattcaattgcattttgtagtttaataagacctccaggtgattcatgtacacggcaaagcatgagaagcactgaaccaggaaatggatagaggagtggatcccaggatgcaaactggcagaatcccagttgttaggagatcacgccacaggcagaattcatctcagcagaaaccgaagtcaccaatggcaagtgttcgtgtatttgtgacattccttgggaattgtgtttgtccttgcacttgcgattttgccttttaaaagagcattttggggccaggcgcggtggctcatgcctgtaatcccagcactttgggaggccccgaggcaggcagatggcttgaggccaggagtttgaaaccagcctgggcaacagggtgaaaccctgtttggtttcatctctactaaaaatacaaagattagctgggtatggtggcacatgcccatagtccagccactcgggaggctgaggcaccagaatcacttgaacccaggaggcggaggttgcagtgagctgagatggcaccactgcccaccagcctgagcacagagtgagattctgtcttttaaaaaagtattttgaaagagtaaaaggagaataataatgtcattggacacatttagaacctatgtatgccaagcattgggagtagaatgcaaggcaaacatggctcttaagaaattcacagggaaggaagattctgaaataatctctctgttcagggctctatggggattcttaaatattgggcttatatgtcttggaagaagagacattaaagtgagattttaagtaagaaaaagtataggcgtgggaagggtgtagcaggcagaagaagcagtgtggatagaggcccagggataggaagagccttgccctcagggctagttcagattggctgcaatgtggggcctgaccagagagagatggtgcttggctgcaagggtgggccagggtcatttcacgcagggggttgtaagcctggtcattaggagctttattctaaggacatcaggaagctgatgaatttttaacagagaattctgagcaggagatgtcaatgaatgtcctgattgtcatccaggtgccagctgcattgactcagcattggcccacgcacactgcaggctgagggtgtggtgtacacactctgctgcttccctggtgacagcattccaccgactctgcccttagatacagtgaccccagatgtcaattcagaaaccacacacccacgttacacagtctgtaagtgaccagccactcaggtgaaacaggagacttgagtgatggcagcaaaatgaattgcctccaaattcaactgaatatgaaaacatggatgggttctcatttcccttcaacaaggaagttccatgtctcaagcactcttttagttactagggatagatacaacagtgagcaaaacagaaaaaaaaaattctgtatttctggagcttacatttggggttagcggctgggtgacttgtatcgatttccatcattatgtccttaatttcacagacgctgaaactgctctggtttttggctatttagagattgcactctcttcctttgtggcttaagctggtgtcacctttacagtaagatatgttacctgaaagagcttttaagaaaattaaatctattttctcctgcccctgtggattagaggaaaacttcctattgcccagtagcattttttttatgctctcagtgaataatgatgataatggcagctgagatttgaatggtaacttgggtctaagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggtctagtcaatagaagaagccagaaaacgcttttcagagaatgagatctagtcttgtcaccttcttcacttaccaccttttcttggcttcccaaggctcaaagaataatatgtaggaactgctaaaagataaactggggcacattcaaattttaaggagtttatttgagcattcagcaattcatgaatcaggcaacatgagacttgggctgttcagagctccatgacaagggtgtgaggggaaaccttataaggtgtttacagaagcacaggaaagaaaatgtttgattggttaaaatggaagtttgtagttcgaggttaggcgttagtttcggattgttaagctcgagttttgcttttctaggctatgactctactctgagttgggttttggtttgcttaggtaggaacccaccacactggagctgactcagcctaatggtctcccagttaattattttaacactatggtggggttacaaggctctgtaccagttggcctccgtttctttgttcagccccagtcctgggtactccccaccccacaccgttctcctcactcccagccacacaggccttctttcagtccttaatatttcccctgtttctttctaccacacaggctttgcacattctcttctcaatgcctaggatatgtcttcttcacatattttctcaaacacaaatgcagatctcagtttcaaggtaatttgctcttggaagcagtccctaacttctctaactacatcaaatcccactcttcagttagttccacctttcaattgcaattaacaaaattgtaattttatatttagtagtgcagtggttttcaaagtgcgactgccacaccagtggcatcagtatcacctggcaacctgttagaagtagaaattttcccactccactctagacctactgaaccagaaactctggaggtgggtggggcccagcaatctgagttttaccaagttgtcctactgattttaatgcactgtgaactcgataaccaccatttcagtatacactttttttttttttttgagacagagtctcactgtgttgccctgtatccacacctttttataatatgcttttggaggttttcccatcaagaggtggaatatatttctctacttatttaaaatacctgactttggacttatgttgtctagtaaaaggcagcaaagttacattgtgccagttccaagcctagatgtcaagaggctctatgctcttccatttactctcatggaatgcccaggctaaagtgaagtggcacgatcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagtggtgggattacaggtgtgagccactgagcccagtctagcgcatgcctttaatggatgccattcttccctcataggctgttggttctatcaggacagagactgagttgttgttgattctctcttgatacccttacttgctattcagtacatgttaggtatccaattaatagttgtttagtcaataaatgagtgagcacacttgacttttgtaatgtctttttaaagaggtattattttacagataaaaaacacctgaggctttgggagttctattgactgctaggtgtgagttatgttgggtcttgtgaatttacaagtttcttctttggagaaaatagcaaccgtagcagctctaggtgcaaaacatctttgatgaagagattccattggtatttcatggataggctgaggaaaggtacttagtagcagtcccctaccaacctgaaataaacctgttttgcttccttccttactcaagcatttctcaagtatactatagctgatcttggcattaccaaaatgaatactatcctcagaaagcttaaattatctgtatgtttacctatctgctgtgtgtatgtagatttcctatagatacacatttttctaaaaaatgctaggcaggcagtgacatatgcaagagaataataatcaaattagtaccaaatacttccagttgaaaaacatagattatgtatttacatgatggttttggacatggaaagtatgagagatatttctcacaaggctgcttatagcaagtaaaataccattagggtagtctctttttcattgaattattcatccagagtcattgagggcttccctagacaatgtttatgtattttgtgtggaaagtataatatccaagaaaaaccattttcatattttttaacacttttaaatggttcactagccgggtgcggtggctcatgtctgtaatcctagcactttaggaggctgaggtgggcagatcacctgaggtcaagagtttgagactagcctggtaaacgtggcaaaaccctatctctactaaagatacaaaaattagtcgggcatggtggcatgcacctgtaatcccaactactcaggaggctgaggcaggagaatcacttaaaccagggaggtggaggctgcagtgagccaagatcgtgccactgtacttggctctgtacaagatcagcctgggtgacagagcctgggtggctctgatcgcccaagctcagcctgggtgacagactgggattctgtctcaaaaaaaaaaaaaaaaaaaaggttcactgtaaaatgaaagttttgttgtacttgctttttaaaatcacatattccattctccctcacccttgctccaacttttaaaaattgactttgtttaaaaaacaaaaaacagctgtacttggcagctggtttggaaacagcattgaagaactgaggaatttgcacaattaacagctatacatagatactggttctaggatgaaaatgtttaacggtgtgccaccaactctgttccgtgtaatagactgattaaaatcttatttacatttcttccaagttcttacaaatcctatatttctccttaattttcatttggtgggttattagatttggttgaagggaaagcgaatgctgtttaagtgtttaacaggctgttttctctactcagctgatgactgttatatttcacatttactctgaatttgaaaactagctttgcaatctcagcagaacttgttactctcatctgaatgtgccttgcctccaccttaaaacaaacctgaatcttaagactgatggttcagattttcataacaatgattaaaataggattctgggtggagcacagtgcctcacgcctttaatcctggcactttgggaggccgaggggggcagactgcctgagctcaggaactagagaccagcctaggtaacatggttaaaccccatctctactaaaatacaaaagaaattagccgaatgtggcaatgtgcacctgtagtcccagctactcaggaggctgaggcaggagaattgcttgaacttgggaggcagaggttgcagtgagttgagatcgccactgcactccagcctgggcgacagagagagattccatctcttaaaaaaaaaaaaaggattctgcatgacaaattaattagcaatcatgtacctcccatgtgctaggcagagcccagtgttaggaaaggctaggcctcaggaaaggcatagtgtctgtcttcaaggtatggagtctgtctatgctagtcctcaggaaaggcatggtgtatctgtcttcaaaacactgaaactctgcatttcccaaaggaggatggctaaaggatgagattcacataatgacattgtgaatgcagtgtggtatcctgggtcggctcctgaaacagaaacaagacatgagtggaaaaactgtgaataaaaaatgtgaataaattctggggtttggttaatggtaatatgccattgttaatttcttagttttgacaaatgtaccattgttgtgtaagaggttaatatttggcaaaattgggtgaagggcatatgggagcttacattagattcataacttttagatttgtaacttttctataaacctaaacttccaaaataaaatgtttatttttaaataaaagcactaggattctagtaaagacttactggaaagctcctgggttatttatgggaaataattattttcaggaaagcaccccattcttgccctccctccctgcagccttagaggatgtgtgaagaattaactggtcactgggagaatgaagttatcttttgtggataagggctgtgcaaaatgaacatagccttgtgaagtgggaattagggccacatctggagaattggtacctgctcaccactttataattgtgtggcttcgggtcagttaatgtatctgagcctcaggttttttaatctgtacaatgaacgtattgttttgcttatgcagacaatgggactactctaatagcgaatttaaaataatgttgtaaaagtgctgtaatcactgtgctctaaaaatgtaagaaaggtacttaaaccttccagccatggccaacatgactaatgacagctgagtggtacttctaggtacttcccagacttgagccttcaacaacctgaactccattgctttattgaagatggagagacaaagctttcctatgaaaaaaatggccaaatgtgtgttttatcctcctctggtggatagtccaagcattgcagcctcttattggacttgagcattatctgcaagagcagttccagacagctcttatgtattgcagtcgctctgctccctgcattccaccttcagggcagctccatccgtttttctttcttatggtgcctcaaatggccttacaacaacagcgtactattaaatgtatcattttttgagaatgcgctaatgcttttccccttatacctctagggtttactttgtcattctgtccttttatggtttatttcaacatacttagcataaagcctagagtggtgggatgcaatatcttaccttagctgaattgtggcctggatcatcagtgtccttcgcaaagaagtatagctgtagattctccctggaggaaaaacccatttaatatttagtttcatctcctttcattttgttcttggtgtaccagaaaagcagcaatgctggctcaggaaagagggacttttcagcaattcatttacctccctagttttgaccttcctcagctggatgtaggaaaaaaagatgttctcatcctgacttcacccacaccacaaatgtacatttagtacctcatcctccggaccagatgttaggcactttaggttcaaagggttgctgcccacaagagttactaactgggaagactgaggcaatgcattaaaaaagctcacactctgcctcatgtaatcaatgccatctggtggtatttccgcttgttggtaataggtagtgataacaacaagaatgataacaacgacaaacattaagtcagctctgtgaaccagcctctaaccaggtgcattatatacgatatctcttttgatatgtccaacaatactagaaggtaatactctttaagatatttttgcaaatgaggacactggggcttgatgaagttaaataacttacccagatataaccattgtaagcagaggagtaaatattttgattacataaatatatcgctgagttctgtcattcagtcttttctcatgacttttcctcatttgtgtcacacatcactcatcagtcttggcatatcatttttcctctggagattctgaaattggcctcgcattgcttcttagccctgactctaagcagccatgatttcttgattagggttggcatagaagataaatcctattttccattcagcgaataaatgtttgttgaaagaaaaaaggcaaaaaattcctggctgaggtgtttaaggaaaagcttaacagaaggagtagaaatttgtctcagccttggaagaaaggtgtagggcctggtaagcaaagtttattatgatagtagcttgattattgagtgcttactttctgtcagcttttgactatagccactgtcaatccatttaaagccacagcatttctagatgatatgtcctattagtatgcccactttacagaagagaaacagaagcacagagagttaagtagcttgtgcaaaatcacatagtctgttcaaggcaaagccaggacccagagcctgcagtcttttttttttttttttttttttttgagacggagtttcgctcttgttgccctggctggagtgcaacggaacaatcttggctcactgcaacaacctctttctcccaggttctagtgattcttctgcctcagcctcctgagtagctgggactaggcgcccaccaccacacctggctaattttgtatttttagtagagatggggtttctccatgttagtcaggctggttttgaactcccgacctcaggtgatccgcccgcctcggcctcccaaagtgctgggattacaggtgtaagccactgcgccccacctgagcctgtagtcttaatacaccatactattttaagagagcagagatgtctgtttactgatgtattctaagggtctggaacatagtaggtgctttatatatagcgaatgaataaaaataccctctttctttggtaaaataaaagaggaaaggcattctagatggggaaaatagcaaaagcaatgatgaagagataccaatgatttgttagtgataaatggatttttatacagcaagaattgaacatacatttggcaaggcggattggagccagcctaaagagtttagactttttgtttagctctcattatcagaaatcgtcacttcctacctgtccaggtttgcataaaccatggatgctctgttttatggtcccatataatgaagattatgtgtaattacttcatagtggattgcactctagcaaaattaactgtccatatttcttctcatgagccctttgcgttaataaatgatgcatttgaggaggcaaaaatggttgggattttctgtgggggaattcctcatgaggagataggaggaatcatggaaaatacctggttctaacaagatcttgattattgacatctgtttctttggcttttcaaggtagtaattaccaaacagagtagtatagatcaccgtaatgacatatttggaattttctgagcaactcatgtttcatgtaaattgaggtatttcgatgtgtttcatcatattagcaccatagaatgccatatctagaactggggaaaggaaattattcataaaaaacaatcttcatggagaattcagctagagaaaaagacggaaatgaatcaaaattccccgcaatcgctcttttccacccaccattcacaatatgtgtttcttcttgagacctcaatatcctgaaagaaaatcctctgtctcagaaagtggaattaatccaggtaatattttgactggattttgactggtaatatcagctgttgctgataaagtcaagattaatgattccttggctaccagtgggctgagagtgtgaaagtcaaaacctgttagaaaccaggggaattgcccatgaaataagatggctttgtgaatgcgtaggtgactctgatttccagaggggattttgcagtaaatcaatccttctaagatatttagcttgtttaactcaatgacattttcattcataatgcttttatttctcatctcaagcaggagagacagtatcagttctgcacaaaactgagcttgaacttttacttgattgtattttcccatctataaactcttatcagggtgctaaaactgggaataaaacctagcagtttgaaaaaatataatcattttattaatgaaagagtctgtggcttgtggtagagtacacattggggcctcatttgaagaattaacaaggattaaggaagagctgcttttcatgagtgcttctctcaggaatatctgtacgtaaacatattagaaatgagtgctggtgagcactttttggacagcatttgatgtaagccctgggagaaagatgaaaaataacaacctgatggtatttagagtttattcatacatttttgtgtatattgtctcattgtaattctcataatagtttgtatcaagcagggtgttattatcatcattttacagatagggaaattgaggctcagatggattcatttactcaccttgggtcctgcagaggaaaagtgaaagcaagtgtttaaacgttgacactcagatctcttactccaaagaccattctctttattattaaactattgattagcagtgattcacaaaggtctgttttgtctcctacaaatgtgtcattgtgtatgcatgactgaacctgtcttcttaggaaatcacgatgtatcggtggttcctgatttcttttttagcacataacatacctttctgaccctgccacctaatgcaaagtgtactactattcactcattctgttcttgcattttgtagattccaaaagcattcattttcacacctactatgggagacggagttaggtaagggaacggacgagcgtagacttgaatagcagctctttttcttaccagcggggactttgcctctcagaaagctacgcaatctctttgagtctcagtttcctcactcataatatgaaactgagagtagtactgactgtatatttttgtaagaataatgtctgtcatcccctagcccattggaggtgtcaacacatgggggtgagttaaaaagagaagggtaagacagtctccatcatgaatacatacttagtccaaagggcgggggaagaagcaaaagtattgcaatcagtgctgtttcctcagttgaataattaatgtaataatactgtttacccaaaaaggataaaatgggataatgcatggagaacacttagaatcatgcctggcacatagtaagtgctcaataatttttagctctaatcatagtaattagtaagtgctccatcagaggcttgcactggtactatggttgctctgaggcaaaagcttcaatcattgggctaagtcagagaaggcatcacaaaaacagtgccatttgaatttagtcttgaggcatgtggaggagccttccatgctgtccagagttcttcaccctgatggctgatttcataaataagcttaagtgcaatgtgtaggaaaattggagtgaaagttggcaatggcgggagtgctggtatgtgttggagtaagggtggcagggactacaatgtcactgccaacaaatggcaaattttatggaaattaaaatatcctgcaaagtgcggattcaaggcaatgctgtcccctttgctacaggtccactgcattaatcacatcctttattacaagtgtcaacacatgattgggagcaaaattctttgaggcttaactgtaaaggaagaaagggataatggcacaaatgctgacctccattcaaatcttgccttaccactaactagctgcgtgatcttggagtaattgcattgcctttctgaggtttcattccccagatcttcaaaggaagtgacaattatataccttgaaatgttgttgtaagcatttgagataataggcatacagtgtgtggtgttttggtagattctcagaaaaataaaaatactatatataattataaatatgattctaatttattttataaattataatatatttacaattatagctaaataccaagcactgtgttaagagctttataggaactatctcctgtaatgatgacatgattaataatgacacatgatggtgatatgattgacagaaagatatcagcaggcccagatggaggatatagagttcttttaatgacaaggatgcagaaacatacggagattgtatagtacctagttttaaagcagcatgcacctagagagaggtgcagctttctgggtctcccagtgtttccctgggacacacagctggggataataccacctacctggagtaaggattctattgggtgcaagaagctccctttgctgtcacaagggtgatttaatcccttggcatttcttccttcacatctgactgttctgggaatctgttgcaacttagagttgcaaggaatgaatgcgaagacaccctaggacatttctgatagttgactgtgacactaggtgatgagcatgtcagttcctcaggatcattccttgggagaactggctttaggtctgtctaatgttccccactacagagcactcagtaacttacccaagatcacacagccagtacatggaaacattaggatctaaacatgatctaagtgttcctaatgaccatgccatatccagttaagaattgaattgtgcatacaatttacaaactagttaagagtagagggaggaaagccaaacatcaacttccaaagcaacagaagttagatattctataataaagttatcggttgcatgttgccggcagaagtaatgaccaaaggagttagagaagacagatgaccaagggctggaatagctgttgaggaggaagtacattcctggcatgcaaatgattcattgcaggagggcttaccacatctgatataccacgaggcttccttgctttccagctgaaatacaaccacaacttcaccctcactttcctttcccgttaagctgcccacctatcacactccaaaacaacatgtgggaaacataccttaaacagcttttaaacttttcttaattctccccccaccacctcttctggctccatagagaataacaattgctaagcttaaaacatgttacaaaaatgttaagaattcttttctcacgttgccaaagtgactactggcttagaagaaagttggaaataagtggtgaaaagcagcttagcagaggggaaatgcgtggtcatttcctgaatgtaaaaaacacctagggttgggataatgtgaaaaagagacagtgattagatcaggcttccaagagttttcgagaggagtgcaccattagaccttgctcagcgagccaccgtccaaggctccctgatcagtctatttggctaagagacaaatgtgccaacctccccagcctcactcaaggactgaggaatcaatatctgggggcatacttgcaaacaattcataaatcttatgtaaagggatttagacaagatttgctttgctagtgaagggagtgggtagaagaattatttaacctgcagctgggcaggttaactagagagaggaagctaaatgtatgctatggtcacctctgtagaggaagagagcacagaaaattttaccttttcctggattaccttcccttcttgtttgcctggtgtcctttttttgttttgtttgtttgaaatggagtttcactcttgttgcccaggctggagtgcaatggcgcaatcttggctcactgcaacctccacctcctgggttcaagaaattctcctgtgtcagcctcctgagtagctaggattataggtatgcaccactacacccggctaatgttctatttttagtagacatggggtttctccatgttggtcaggctggtctcgaactcttgagctcaggtgatccgcctgcctcggcctcccaaagtgctgggattacaggcatgagccaccgagcccagctgcctggtgtacttttaattattcttgaagatccaaataattgcttctcttggaagctacctttcacaggcagacttcatagcttccatatttgttcttgaatgaactccataggttacaaggatttcctcacaagtctgtttctcctgctagagtcactgagattgtgatactaaacagtgacttactcatctttgtattgctactctctagtagagtgagtttactggttaaagcattttcattaaatgtttgttaagtgaataaatgttgatatatatatatatacacacacacacacatacatatatacatatatatctttatatattctcaccttcccccatccattatttctttggctaaggccacctggattttctctgttttcatctccatatctatagactgcatagacctctcacacaaatttgcattgctagttgaggtgttctttgagcttctcagtggttatgacaaaaaggactttagcagtttgtgactgtgccctggaatccttcagcagactgaaataccttcagctgaaggagatggtgtttatgcagaagcccagcacctagcccatcaagcagtctgaggtttcagttggtgccagagataactccagtgagagaactcggtctaggtttttagaagttcttccccagctaaagatgacatcttaatatataaaggtttaataatcatggatggtcctttgtagacatctattgctgtggaaactctagttctctttaccttgagtagcttcttaaaaagaaaaataaagagaagaactagcagtgggaagggagaaggggtatcaggttgtataagcaaagtgatttctctggcttatgcttctataaatttgtttataaccacaaacctctggtaacagggcatttgcagaaggaaaatatttatagaagtctaccttgccaattacattgcaaaaaataaattgcctttagagtccttaaaaaaattcaaatatgttttccctctccactgccacccccacatcaataatttgcagctcgaggtctatgtctaaaggataagagtttccacaagttgattgtggatatctgaaatcaaatttaattacatgtgatggatcaacttcttgaactcccatatttctttcattgtcttcttcggattccatgcctcacctttgtggaaactgaactatagagaaatgataacatgactcagagccagccctgcaatcaagggggagtcatctaacccaaattggtgagttcaggtcagcagcatatagtgtcttggaaagagcatgggctttgcggtcagatagacctccttgaatttgaaacccagactgttattaattatattgggcagaattcttaaactctcactctcctcatcttttaaaatgaggtttgaaattcatcatggagctagcatgatgatttactagggaacatttctctgggtatcaaggtcctcaacactcagattgcacttgctctccaacagaatttcccagtaattccctatgctagttttcttttgctgcataacaaattactagggacttagctgcttaaaacaacacacattgattacctcaccatttctgtaggtcctaggtccaggcatgaattagttgggttctttgctttaaaactgcacaaagatgcaatcaagcacagggttgtgatctcatctgaggcttgggatcttgttccaagctcacacggttagcaggatttaattccctgaagttgtaagactgaggccctcagcttgtagaagctgctcagttccctgacatgtggcctttccataggtgtttcataatatagcagcttcttcaaagttagtggtaaaggcagtaaagaaatacatttacatttatatttactaatgtaatcacaggaataacatcctatcacctttgccccattgtattggttaaaagcaagtcacaggattcccacccatcctcaagggaggggaatcacatgaaagtgtgaatatcaagaggtgaagaggaccgtgtcaccctagggtctatctaccacactgtcaacgtgcaatacccctggcatgtgtcgcagagcgccctcttgtctgtgtgggttactaattgttacagtgaaattagattcctctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaaaaaaaaaaaagtacagataggtaactagggaaattgttaacccaacaaagagagactacatgagtctgagtcccttgggaaggataaacatgtttgtaaataaatttatttctctgtcaatatttacttttctttgtgttcctctccatgtgctgagaatttccttctcaggccttcatgattctatgagtgaattactagaaatgctgttagtctcattatttttgtaaaagaacaccttgtgcctgttcttgggctcaatttaagttagagaaaaacaaaattcatgcacatgagagagttcttataagatggaagagacatactattgatctaagacttatttgttttaataggggtccttagtcatgaattatcagtaaaaagcattttatagtaagtgcaattttggcaagaccttgtttctctagttgcataaggaatcactacatgataagaaacaagaaaagtttactggcagaaatagagaaaagatatgtacatctattttatctacctaaacataagtagataaaaatatgtgtaaatagttccttatgtcaggaaactgtgtctgaatatctttctatccttaaaggcccggcacagtgctaagtacatagtacacagtaagcatatagtaaatgtttccatatttcagggacagagtttggacgctaaaatgccaatatttgtttggctatagtgatttaatccaggaaaatagaaattagtttccatgctgtctctggaacttccacaccattctcccagcattttcatctattcaccaaactagaagctctccaaaccccatgttttaaggtttttaaggaggatccattacaaaggcatgattaattaaatcattgtccactggtaattgactcaatctcctccatcttcatctccatctctggaagtctgggggtagggtttaaagttccaaccctctaatcacatggttggtttctttggcagtcagtccccatcctgaagctatctagggtccattaagagttaccttattaggataaactcagattatggttcaaaagggctacttatgaataacaaaagacactctcctccctgtcactcaggaaatttcaaaggattttgaagctcttgtgatagaaaccagggacaaagaccaaatatgtatttcttattatatcacaatatcacaggctgtcgctgtatccaaatttcccccttcctgtaaggaaattaaaataaggccaaccctcatccagtatgaccttgtcgtaacttgattatacctgcaaacatcctatttccaagtaaggtcacatttataggtactgggggctaggacttacacatgtctttttgaaagacacaattcaacccacaacagtaactaattgacttcctttctcctgagctaccctgtgattgaggcagagcaattttctctaaggacatagcactgcaaagatagagcctataatcaaacatcctagttgctctttaggagctcaacctaggtctagcctgctcaatttagtatagttcacttctacgaataatactgaacccaaagcaagactctgacgaggatcgagaaagcagtgacacacctaaccatgctgtaaggcagaatagaagagatataacagagatcaagtgtgtaatctagaaaagggacatattgattatgctgaggaggtaggcatgggaggcagtagccatttgagaggcagaagcagcaggagcaaatgcatagagacaagaaacttccatctattgagtgactggttccacttggctgaagtataaggtaagtttggagggacagggatgccagggtgtggaaacacaggtttttgcttatgagtcttcaatgtctgagaaaaaaaaaaaaggccgcatgggatgttcttgtctatttttgctgttaggtgataaataggcagatatatctaggtatgtgtgtgcgtgttgccaagggatctgtatttatacagatttagtgacaacatttattaacacaacggggtgataggctttggcatcaggatgttgtaatagttgtaatttggcttgtatcaacatccctatttttgcagatgagtaaactgtggctttgaacaataaggacctcacccagggtcgcccagcgctggtaaatgttgggtttaggaactgaacccaggtctagctggttccagagcacacattggtgctttccgtggcgtggcctgtaggtgacttctgagggaattcagctccttggtgctgagggcttagccatgattcctttcagagtgagttctccatgtcttctttggccaggttcctgtgctcagggggattttcaaagataatggtgtccactggagggaaatatatcttggagcaaagatgtgcaaggatggttccagattctccattcctatttatgaaaactggcagatttgctgactgtgaacatagtggccaaagggctgaatagatatgagcatttgagagtaaaatgtgttttgggaagctttaaattcttatttttgaaataagataataaatgtccaaatcaaatgggaaattagtgaccaggttaaaaaataaactgaggttttccaactccaagttcagtgtattttctattttgttaaaaaagtaaaagtaaattgcaaagaagatacttggagaggaggaacaaagtaagtaaggcaaggacatgatggatacagggggattaactggggagggaatgtctgtaaagtgtataaattttggggttggggggggtacagctaaaaggagctgtcctaaatcctggcaaaggccctccactttaataagcgttgtaactttctctttcattgttggaggtaacacgtatgaaaggaaagcagcaatcagaacaatgcagtttcccagagggctctttagcagaagtctcctgtggttccatgctgttgttaatgctccccttattttagtctcctggactccctaaatgctttggaccacttgagcaaggccacgttgctaattgtgcagaaccccttcagaggtggcaccgctgagcaagaccaggcaactcaggctctaatgggccttgattgtggtctctggagcaaaaaccacctcttgaaagctgctgtgagacagctattgggaggtttggtaggaagatttagtgctgctctttgaaggatcgatgtctaagctcttcaaaacctcctgacacctcagatggattctaggtggttccccagtgggcacaatctcattatcatccacatacatttatttatctcctaataggggcccatcactgtattatgagggccgcaaagcctagctatggggctaaaacaagcacacatgaagcaatgaatgagtattaactgctgagatgtatatttctgatggcctcttcaaggtgcagagaaagaagatctcctccaagagaattaaatggtcagaattggggaggtaaaaattagaatctgaagaaactaaacatgctttagagagacaggtggttggcatcagaatgaattcctggcaatagggagcaacctgcagacagggaataagaatgtacacagaatggcctgagtagaatagaaaatgtgtgtctcttttgattataacaaggaagaagtcaagtttgtttttagtttgtctgtaacacccactcattcttaccaatttgccttatttgcaaagagacagctgtgcccaggcctttagaaaggaacagtatctaccgtaatttattggtattttattttcattctacagattgagtattccttatctaaaatgcctgggaccagaagtgtttcagattttggatttttttgggtctggggatatttacatgtacataataaaatatcttggagatgggacccaagtctaaacatgaaattcattatgtgtcatatataccttatatacatagctggaaggtaattttatacaatattttaattaattctgaatacctgtcacatgaggtcaggtatgaaattttccacttgtggcatcatgtcagtgctcaaaaagttttgaattttgtagcactttggacttcagagtttcaaattaaggatgctcaacctgtatttatttttacggttaacttctataggcaagtgacactggtttcaatgaaaatgtatgtaaatgaaaagaagtgaagcaatttaaggaaaaagacgaaataataattcaggtagtatatagatggggcaaaaatatgtgatattgacgcaccattgaccaaagtttgggaaaaagaggagtcatagtaaaatgttgatccttgtgttgaagtttctgatcctccttgcactactcaccatagatactccagaaaagtggaagaatgagtcaataaataaatcattcatgacttttccaaaggaaataatccaactatctgctaataagtgtcaaaactagggtaatgacaatgataaaaaggaatcaatccaggtgacacttgagagtaagaaataacaaataacagatcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcctgtgaaatactctaaaatcatgatttcattaacacgggttgtttgcacttgaggatgaagttgcccaatgttacactgtaatgggcaaaactgctttgcaaactcaagttctctaattctggatgcttttgtgtgatgacttattgctattcccatgtctctataccaatgacaaaacctttcaaccctctgagtttttcccctagctcctgggactatgggtgggagagtctgagggtcatctattgatattgaatgtggcaggagtgagattcctactcctccccttcccttgcccttcttttccaagggcataagaaggaaagcatggagtgtcagccaggctgcatggagctgcctaccagccagaacctgctaattcttattttatggaagtacctgtcatgtttggccaaatctcctacagaaggataaaggaaccaacacagaattcagctcccacactcccctgcagttataaaacttacttagctttatttaatttttaattttttttttaagtttagaagcttcagttgagaactgcaaattaagttgcgttcaatagtcttttccagctcatatgctgctgctaggttgcaattattgctcgacacccttcctcagtgttttgacatcttcgccagcctgagaaactaaaacacaattatttattaattttaggtgagttttcttcaattttaataattcctatactttatttacttatttgtttgtttgtttgtttctttattttgagatggagtctcactctgtcaccaggttggagtgcagtggcgcgatcttggctcactgcaacctccgcctcccgggttcaagcgattctcctgcctcagcctcccgagtagctgggattacaggcgcccgccaccacacccaactaatttttgtatttttagtagagacggagtttcaccacgttggccaagatggtctccatctctggacctcgtgatcaaccctcctcggcctcccaaagtgctgggattacaggcatgagccaccgcgcccggccacttattttcttatttgcatgctttatacctgctattacttagttcctgtgatgtttcccagaaatatggaattagctgtgccagacactatggccagaagactcaacagtcacatagcgttatgatggttaaatgctaggattgaatgttaaataaattttaaagtaaattttaagtggctgcataataatttattgtgtattcactaataataaatcctaagaatctaatatcccaagataaatgagcccaagaatttattcagactatattctgtaatattctgtgtgaacaaagggaataattggatagtttgaggggtaccatgatttcttacatgttgtacaacttaaatattctaagtgtatcttagatcacatgctacaaatttctattatcactattaatagctatcagatattgaactctattaagcatcatgtactttagtcaatatttgaaaccactcattgaggtggatactattatctccactttttaggtgaggaacctaagagtcaaaaacagaggttaagagcaggtgtggtgccttgcccctataatcccagcacttttagaggctgaggcaggcagatcgcttgaggccaggagttcaagaccagcttgggcaacatagtgagacccttgtctctacaaaaaataaaaatacaaaattagctgagtgtggtagtgcacacctgtagtcccacctacttgggaggctgagacagaaggattgcttgagccaagggtttgaggctacagggagctatgatcatgccactacacgctagcctgggtgacagagtgaaaccctgtctctaaaaaaaaagaataaaaaatagaggttaaataactcatgggtaatgagtggccaagcttagattttaactttttaattctaccatccatgttctcaaccattacactacacccatttaatattatcagtagatttatctgtatctatcctgaaggtatttattttcaacctatatacttcctgcataatgtgatttataatcaatatttttattccacccctaatgggtataatgcactatgctcagttctgttgagaaatgcacagaagtaaaagccatggtgcttgtttaagagctttttacaatcttgttaggggtgtggtgtgtacatatatacaaagtttagtttagtagaaggcctcagcatctatacaagttagtaggataaaagctatcccatactcagaaaaaaatttcaaattagtatcatggttaagagcaacttgtctaacctgtggcccatagggcacatgtggcccaggatggctttgaatgtggcccaacacaaattcataaactccttaaaacatcgaggtttttgtattgttttgttttttgcccatcaactatcattactgttagtatattttatgtgtggcctaagataattcttcttccgatgtgacccagggaagccaaaagattggacacccctggaattttacaggaatgaggtgccattgtgagatagggtggcctgacatattctgctaggtcaataagtatctctgatgtggaaaataactaattgtgggttatatcataaactattctctttttaatttgaagacatgttcctttctttaggtatttctcaatttgttaaacaaggccatgtttgatatctgtattttaaaatactctactccccttttatccaagatttcactttcctcagtttcagttatctgaggtaattcctgtatgaaactattaaatggaacattccagaaataaacaacttataagttttaaattgcatctccttctgagtagcaggatgaaatcttgtgccatcctactctgtcctacccagggtatgaattactttttgtccagctggccagttattagattgtgttaacctttggggattcaccaagaaccaatgttatatatgatccaagagtccacttcagtcacacactcacacccagaatgccagaacttgcaagccactgtgtaaaatatagtctggaaattattttatggaacatagttatatggcattatatgaacagttcttcaagcatgtatacatataatgatagctatattattaaactgtgccaattgcctgccctaccctttccacattttaactctgattcctaaactgttagtaaattcagaattctgagtagtgttgtgcaatttcaaaggacctgccctttcatcatactgttctgtctctgattaaataccttctttgtgtagatccttatataacatagagacagatataatccttctaaatggtctcgtaattttgtataaacccgagcagataatagtattgggggatataggatttagagaaatttattctgataactatgagaagaaatttataggtcagtgtggcattatattaatcctttttcatcttatcacacatttggctcagaatataaaatgtgtacagacatgagatctgtacattaggtagttatttatttttctttgaataattcctttctaaaacaaaatgttggtcagcagaggtggtaaaaatgctagattgttggtcttgtttgctaggattcatgacctgtttcataaaggactttgctaggatttgtgacatgctccatgaaggacttaacttgatcagacacattaaacttcggaactgaaagaaatatctgagcttgttcaacccagaggttctcaaacttcagtgtacatcagagaccaactggagagtgtattataatatagtttgctgggtcccatcctaagagtttctgattcagtaggttggggtagggaataagaatgcatttttagcatgttgtcagatgatgctgatgttgctggtctcagagccctactttgaaaaccactggtctattgtaaggctttctttttacctatgagaaaactgaggacatgagggaggccattcatgtacatatattattcaaatcctgttcctttccatccaaaagccctcatgtggtatcctgttgaagtttgaataaaatcccaaatccttattatctagaagatcttgcatgcctgttctctgcccatccttccatatcagagtctccatagagccttacttactttcactgcagttattcaatggacacattcttatttcagcatgaaaaacaactaatatgggcacatggcacagaacaaaagtgaaggtttgacttacagagaatttcaattccatttttcaattcctgccattttcttgggggctccaaatacagctaatataagtcgcatgctgagtgacttgtcagtctatattcccatgtggtgggtccatcttgattcctctgttttatctatcagagagtttgatcctcattataataatagctattcataacatgtattcatcagccatgtactagctactgtgtcaaacagtactgagatttagatgctgacttctgaggctagactctttattcttagaaaataaacaacactgcccctctattatatactgaaataatagtgatgtttgtctaaacaaccctagctggtcaaacaatggcaaccccttcccctggctgctgttttactcaccatttaacaaaaaattaggtggtgcctttggaggaagagaagggagatttaggcggaaggatttttttttaaaaatttatttttgagacagagtctcgttctgtcacccaggctggagtgcagtggcaccatctcagctcactgcaacctttgcttcctgggttcaagtgatcctctcaccttagcatcccaagtaactggaactataggtgcatgccaccactccggactaatttttgtagttttagtagagacagggttttgccatgttgtacaggctgatctcaaacccctagcctcaagtgatccgcccacctcagcctcccaaagtgctgggattacaggcatgagccaccacacccagctgaggttgaagggattcttacaaagacatgtgaagagaataaattgaaaataaatatgattacattaaaactaagctcagtactttaagatgtcatgttctctgacttgataactgaagaatttgtgtgagtcatgagaagaaggtaatttgttgtactttatattttcagctatccttgagaatggtttctgcttcttacattctcaatgatagacaagtctgacacatggagtttactttaaacggttaggcaatcccatgggttgtggcccatagggtgataacaatagaatttccttttgtctgaccttaaaaaaggatatcagataaatactgcttccttggtgcagttaattttaggccaaaatacaattattggtcagatgcacaaattatctctttatttcttaaggattagaaaaaattttgaggaatcctactttcttcctaaagcagatctgaaatagaaataattttatacaagctaatttttccagggtttttgtttgtttcttcttaaaaaactattttaccagaaaatatgaatacgttctgaaactttaccataaaaaattctcatttcttcccttcttttccttttcttttctcttttcttttctttctttctttctttctttctttctttctttctttctttctttctttctctctctctttctttctttccttctttctctttctttctttctttctttctttctttctttctttctttctttctttctttctttctttcttttccttctttcttttttctacctcttcttattttctctcattcaagcattaatgacctatcaattctacagatagttaattcacacttacaatgtgcctgtcatatttattttaaatattgaaactcactagaaccaaagtccaaatatggatgctctgtcgtggtgagtccacttgttacaaggaccctggaaaatgaaatcaacttggatagaaaccaacatagacccaattttatatcattaaaccatcttctattctaaagaacaactgtatgtgtattacatataggcttctaatagaatttctgatggacatatcagcaaatttaattcggtattttaaaaaatacatcctaaacaaaaacagatttttctcaggagtgtgagaatgatacagcatcagataataaatttaatataaataatgatattaaagataaaggaacagaagcaaaatcatttcaaaaatgtagaaacatttaatatagtcagcatatttattaaaagtaatctgaacaagcttagattggagtaggacatttttacctcaaaaacaagaagctaccaagaaactacagcaaacatatatttacattagtaacaaagcaagaatgaatactatcattgtttctattgattattgaagtgaaaaaactagccaatggagtaagacaaaacaaaaaacaaaaaaacagaagcaaaaagattggagaggaatctacagtacttttatttgcagaaagtccataagggtttattggcagactattagaattaaaaataatttccacaagtttgttgggtacaaggtaaacatataaatctaattatcctctccctacaattataattaccaattaaaatgtagaactgaaaaaaaattcatatacaatagtgacaaaaatgtaaggaagctaagaataatcgaataaaagattcaagaccattaggggaaaaatgacaaaatattattgaagattataaagtcctgaataagtcatcaacattgaccatatttatgtatgggtagactcaataacatgaagatgccaattttttctaaattcttctataaatccacacatttccactcaaaactccaacagaactgttcatggaatttgacaagctaactctaaaactcatgtatgatcacggggccaaaaatagccaagacaactcttgggggtggggaaaaacccaagagaaaagacttgcccaactagacatcaaggcatgttttatccccaaattaattaagacagtgggacatcgacacaaaataggcacaccagcctgtgggacacaatagagctcagtaactgttccttacagtatggaaaattgatccttgaccaggtagacattgaaaatcattagttaataaacaaactagtcaacctatgatgctggaataatttcttatctatatgggaaaaaatgaaattagacttcattttatatcacccatgaaaataaattaaggatatataaaaatttaaatgtaaaatgcgaaactttaaaatttttataagaaaataatggtgattagctttacgacctatgtatgggaaagatttcttaaaagaagggaaaaaagcatagatcattaaaaaaatattgatatatttgattacaattatttttaaaacttatgttccagaaagatatgataaattaaaagacgagctacagacttggagaaaacattggcaatgcacccagcacacaaaggattggtattctaaattgtataatgaccccctacatgtgatcaagagaaagaaaaataacccaatgaaaaatgagcaaaggatatgaataagcaaatgacagatgccaaaaccaaaatggatagttaacatataacacataaaagcatgtatagccacactagaaccttgagaatacaaattcaaaaagcattgagatattacttcaaaccaccagagtagcaaaaatgtaccattctgacagtattaagtgttggcagggaggagaactaagagctctcatatcttaaagagtgggaatgtgaattgaggcagccactttgaaatacaatttagcattgaagctacacatgacatttggcctcacaattgcatatttatgtaaacacttaagggaaactctcaggcaatttacattgagctagttattagaatgtacactgcttgttatgtgaaaaaaaatctaaatcagaagagtgcatcaataaattgtggtatctctatataatataataacatccaatactggagcagaacaaatgagagctacatgcaacattagtgaacctcacagtcatactcttgagtgaaaaaagcaaattactgaatatgcaaactgatactatttagataaagcttgtaaacatttaaaataatccaaaatatttcatgtgtagtttcatatatattaataatataaaaacatgcatggacatgacgaatgtcccttttagaaagaagaaagtgggactgttacaagaatattgacctatgcctgtaatattttatttcttcaaaaagaatctgaaacaaatataccagaatgttaggaattaataaaaaccaggttacaggtatgtagatatttattatattattatttctacttgttcgaatgtttgaagtacttcaaaattaaataaagaaccagcctcactgagatgtgtgtgctgagtgctctactaggtttattcacaaagttcttacactccctgctctcaatgggactgatgaaaatgtatgactcaaccaaattatatatgaccgcatagcatgacattcagcctcattgagaaaatgtcaaaattgtgaatgttaaattctaaaatatcaaggctcaactgtagacatacaaaaccaactagggacataaagaataaaaatgaaaacaaaataaaagctgtttaataatagaattcagaacaatatataatctcttcttccctgctaaaatcaggccagagattggcatttgccttcctgaaggcaatagttagcaggaaaaaccacacaggttcatataatacaaaccaaaacaaaacaaccttctcacacgaagagaaaagaatactttgcaaaatggctgctgcatcttcccaaatacatatttcacctccccaaacagattttccatccttgaccttctcgttggaaacctctccttaagcagttacacacagctctgcaaatgttagagtgacatttggactgggcttgcgtactcagcttgcccgctcttctgggcttccccgggggtctgccaagctccagcacattggtattagccttgcaggcctcacctcccagagctagcaataacatttaccagctacagttttctccattttcaaatatttcctctggcccacatgccagtgatccagctcctccatagagtagaacctgaaaggagtggtttaaagaaaggagagccctcctgtaagaacttttaacatttacctttcattaaagattttacttgtggtttaatcgagctctcccactagaattctggtatgtttgggaaaaattaattactaaaatcttacatctctgggaggcggggtacatctttgatcattcttttgtcagtgaaaactctgaaaaacaacgcctctggttggaaaggaatcaaatctgagcttttgccgaaagctttttgcaatcccaagaaatctggattgaccaggaaattctaaatcataactgtagaaacagtttcacagccttgctatgcctaatatgtgacagggactgggtctaaggaccttcataaagtcaggtgcgttgtctctctcatttgttgtatccccagtgcctgaatgaatggatgaggaatgagttgaatagtctcccaaaagctaatgagtcatgagctaatattatccttatttcaccaatgagaaacctgagactcaactgagagatcaagtgacttgtccagtcacagagctaataagtggcaggcctcatatagaggctgagaacttcattgtgctggtgtaatctgtactagtagagatacatatgtgttcaaatgtcatgataagcactggcaaggagaggtaaacatgaataagaacacagttgagtttcaactcataaatgtaggaggaaacaggaaaagagaggatcaccagtagacaaacaccacattaataaatattgcaagcaagatcactgatggatgctaaaattagtggataaaagtttgaggagaataatatttgcataggctcaaagtattttctctaatacatgtatcaactacaaaggaaaatacaatcatttagaagtagagagacctggaacttggaagatcctgactttatcaaataagcaggaaattatcaccaggaacaaggcatgggaatatcatgaaccccttgatagaatgcactgaaaaggacacaatatcatttttatggtgttcttgccaaaaacatgtaacttctctccaatcctgaaaaaacactggacaaaaccaaaatgaggatctttgatacaatatctgactagttctctttaaaaagacatgaaagacaacaaaagactgaggaactattgtagactggaagggagcatggcaaaataatagctattgtgatgtaggatcctagaacagaaaggaagagaaaaacatattaatgggaaaatagtaaaatttgaataaggcctgaagtttaaaatattgaatcaatgtatatttgctatgattgataatcataccatggtaatgtaagaggttattagcattagggggagtaaggtgaggggtataagaaactcagtataatttttataacttttctataagtatgtaagtttgaaataaaaaagtttaaaacaattaaaaaatgagcagaaaatacatttgtccttccagtttgcttacagaattgagagagtcaaatatgtaaactaaactaaagtacacacaaaaaacagtcctgtaggcaccgccgataataaatgtatgtaccagatagaaggccatggaaaagggtggtcatcttacctgggaagagagcacaggtagcactcaggataggcttcatagagaagacgatgctcaaagatttcttatttatccaccatctgttttatagagcatctactatggaccaggcactcttctagaacatagctacatcatggtaaacaaaaaagaaaaggtatctgcattcttggagcttacagcctagaagaagtcagataacacatgagaaaaaaaaaaaaaaaaacaacaccaaacaaaattaattagatattttcggtgttgtcatgaaaaataaatgagctgatgtgatagaatatgctcagggagataggggaattggggaatacctttctgagaagatgatagttaagctatttgggctagggcctgaatgggaaagagccagccgtgcaaaatgaacaaggagcaggtaattccataccaaggaaacagggtggctgaatgcccaaatgcaagaacaaattagtatgtttgtgtttaaggaaacaaaagtaagccagcatgctgggctgtaatggacaaggaggcaatagtagatgatgagctgtaaagtaaggtcaccaggtggctctaagtccaaactggcacacttttgagtaaaaggtggtgctattaataattacaccaggacaacagaagtgaaatgagactgtctggccaaacctggacataagatcatcctttagcaaggaaagaaatcacgtaggacttggtgagccagccaaggagtatgaagttattcccagtgcattaggaagcatgggaagttataacaagggtaggaggtgattgttctggctgccatgtggagaacccactattgagagcaaagaatgaatgtaggggggatcattaggagatgatttcggaagtctagttagtagacagaggatgggggctttgactacaggagtagacttgggagaggagagaactggatgacagtagagtcaatgagccttgcgtgttctcagaagatagactgagaacattttagacaaaaggagcagcctgagcaaagtcacaggggcagggcacgttccaggagccaagagtgtattctatggccaaagtgaaaggaacagcaggggcaggccattggcctggagataagaccaggggctcagatcatatgcgatttagaattcaaggctaagtagtaagaactatggtgccattgaaagtgatatgattagattggttttagaaatatgagtctagtccaactataagagaaaaagataaaatgaacagaaaaatacagtgaaaacagagatagcttttgctagttagagaaataaacaagaagacattttgaggatggtacaataatgtgggagatatttttatttttactggaaattgtccacccattcatcagacacacacttgatcatctagtgttttgcaatataattagttgttgactcaaggactgctgaacagtgtcactgagtcataaagacggctccaagaggaaaactttgggcacaaattaatgctatgtaccctctactttctatcttctgctgcagcgctattcttggcccactcatttctaagttttagcaatatttctcaggctggtgtgcctcacatgcaattctggcaagctaaacatggtgacggagccagataacttgttccctgtagactcataaactcatcagctgtgggctggtaatataatttacaatatactttgccagccctataaaacagcttttttcttgcagagaaatggagccctgacaagaagtgtttatgacttaattttagctgtgttcttcgttgttgctgcagtagtagcctgcgtatgatgcatcctagtcatccgccaggcagttacaactttgttgttgttgtttttggcaagctaaggacaacattagactttgcttaatacctaccccacaatcctatttcaatggtggccatagcatgtacctccatgtttatgaataaatgaatcgagacacagttgttggatacctcacagccgtggcttataccttgatgaaactatatgataccatatccttctagataaagttcctgtaaaatgatattgttagaaggcttgagtggaaaaatctgaaatatgctgtttacagtcaaaatgattatcctcctgctgactagttgttctttattcttctccacagtgtactacaataactatttaccattcatatttcaggctaataaggttacttctattcagccattacataatgtgactgtagctaaaattaaagctccacaaggtaggaaatttgttttattcattgctagatcctcaaggtctggaacaatgcctggaacaatagtatgtactcagaaactacatgttgaataaataagctcaactattgacatattaaatctaccctaatgatttgggaactaatactacaaatagtgtagtcatcttccaagaagagcatattctcctgaggttggccagagggttgatgaattgatgtatcagccctgatacattatatagcatccaacagtcattccaataacatgctaagatctgcaaaactgtaactgcatatttgaattcaaatccagggacagttttttaacctaggtaactctagattctactgtacacaaagttagagttgtgagatttctctttattaattctcttttttctcttagccacatccactaaaaaaggtacttttatttcatgtcctgtatgagttgtatgtaacgtctggctctgtcaccattcctttgtgttctcattccatagctaactttccttaagaagtgttgtaatagcatatatttcagtgttcacaaaaaaacacaaaagcaatgttctgactaggtgactcaatagattttatgtgttttatatatacttatgtatatgtacacatatgtatttaatcatctgtttcacaacattgttgattttgtttttcctgattttggaagcaggattccaaataaggacagtaaaaagcaaactttttcatatctctgtaagaagggaaatcaaggctttaaaatattacctcagtttcctcaggtatgaaataaaaggtatgaatgcaggtaaatttcaactttctttctaactctaaatttctatgcaattcagagacagtaatatgacaacttctatggttctttttcgataaagtgacaagaaactgattttactttaatcagtttatcagacttcttaaattttctttgttggcttgacttttctaggaaattcatcctatatcttagacaacataattttggttcacgttgtatttgtgacccagtttgtccttgtaagttgtatgtatagaattgaggtttgttgaactggcacattgtgaaacaactgccaggaagaaagtatattttcttctgccaccctaaaggatttatctctctgatctggcctcagataatatggaagcacccacattctagtgagtacaactgtgtgtggagcagttcagttatctagcccttcaacatagtcatttggaaatcaaaagcgttaaccactagattagataagacaacaaaatcaagagttcagttgaccattaatcatttttccaaaatcagctcaatgacgttgtgtaataatatttagaataaagcaaaggtaataggtataaaaatccattcatttacagatctatacccacagtcaaacatccttcttgatggttcagagctaaagcctttattcaaattttactaaccagttattgtcaatgataatgagagagtaaatgtattctctggaatactgagaaaaagaatatggcagagtgaggcagcaagctttgagcaaaacaagcaagaatatctacagaacagtgctgttcaagatgaaaagcataactggaccatgatatcaggctcaatcactaaacatagcctgcccatgactgttatgagccattcttaccctcaaagaaatataaaagatttaactttggatttttgaatgcaatctctaccatgattgtgaaagtagatccattgtgtagggagtttgagaacagaagaaagcagaacgtcgcccttatttctctatttaatcaaagtagacttcataatgataaggaagactaacaaagaattgtaattaaccctttacaattatgttccactttacagtttgaattgcagagccctttcaaacatattttcttatgcagtttttaaatatggttcaagatttacgtaagggaaaagtaaggtcccacggttgcatgcccgtgagtagtggagctgggacctcctaacaccaaggctctttctactgaccagtgctacctgcaacatggaagtatcctctcatggaagcaatgggccacctctagacctcaaggaaattcaaacacatatgtacatgcatatatatacaacatgtactgagcatggtattatcaggcatggcttggatattttcacattcatacttcagtgttttcctttgtgctggatacattttccttgcaactctggatccatttccaatctttctccacccttcttcattcagttttgcaccttggaatgtgattctatgtggattgccctgacagctcccttgtcttctgtatttcagttgagtttgtcctgtgaaaaatactcatggaagatgaaaggaaaggatgagaatgagatctgggtatttaatttcctggctcttggaaaggcttgtctgttgacctcaaggtctccactcactttatctctttcccttcctctgcactctagcaattggccctcccctagacccattagggaaagtaaaagggtctgctcttaatagacctgaatactgcattacccctagagggcccactatctcttacctataccttttaaatcttacctttattaaactttcatcaaatggcacaattcaaatgggccatctgttttttaatggtttcctgactgattcggtattattattacacttgggaaactgagtcccaacaaggttttaccatgaaataacttgcagacctggaattccacccagatcttctaactccaagcttatatgcttacagagacagcacaccaagcaatgattctgaatgggaggctgacccatatgtgtaatcacagctctgcacaatagagctttcttgaattgactcagagcaattctcagaaacataccactgtcatttataatggtttattttgaaattttataacatgtttgcacaataaagcaatggcaaaagtatctggaagaaaattgaataagattacatctagtctttcactacaccacttggtcttccctgaatcaccggagttagtctaaaaagcaagtctgatcatgtcactttctatctaaaaatgctttctattgactaatatctaaacttcctaactgtgctttttagagtcatctatgtgttcccccatctcaaattttaccatttctttccatatgctctagttaaggggttctcaactgggggtgacttttccccctaaagggcatttggaaatgtctggagatgctttcggttgtcacgaccaaagggagtgccacagatatctagtgggtggaggccagggataccgctagatatcccacaatacacaggatagcctttgcaaccaagagttatctggtcagaatatcagcagtgtcgctcttgacaaactctaatatactccagccacaccaaattcctcctgaaccttgaattttctgcatggtattagattggtgcaaaagtaattgtggtttttgcaattaaaagcaatggcaaaaactgcaattacctttgcacccgcctaataactatcattcaccagattctgtgcttaataaatgatttcatttcatgcacttgtgaaagctgtgcttctacatatgctgtttcctcagccagagtgccttcccactcttctctttgctctttactcttatattcttgaaacatggtttacaggtctccttcttcttaattctcatctatacctttgtatagatgcctaagctgaattctcacattttctttattattcaagtataacagtttacctgtttgagtctacaacacccacttgctatattctgtactaatgacagagaacatgctatttgtgctttcccccaatttcagcacagtgtctgtcacatattagatattagtcattgaatgagagaacaaatattattgcaagcagttgatagagttctgaagaattgtgttatgtttaatttgtataaattaagtcatattttaaaattcagtggtaaaaattgctatttaagaaaagtctctataaactttttggtaaattgaaattctattagaaggtatacatttataaaccagagtttctctattccatttttttctcttttgaatattaaaaatatgaaagagtacatgcctgcttttcttaaagtgataaatatcaatccaaattgttgtcatccctttagagtgctctagattttggggaatgagaagccaatatgaccatatgtaatggcaggactccgttgagaatgtgaagttagttttcaaccttgtccacaagagggaggacatcaccccacatccattttgttgattccctggaaccgttgggtctgtttggagctggagatttatgttgctcctgctgttgcaaaatacagatttagaacctggcaggcattcttgcatagatttgcatgcagtttaagatcagcccagtttgggtggagggaaagcaatctgggcattttagaagctttgtcagaataaaacacacttaagcagtgtgtgatgccagttgctgcatgaatgagcaggagagtgtcttgaaggtacagaaagagaaaagggtgagggatgtgataatttggtggtaatttgcttacaaggttgaccaggagagtgtcttcttttcacaggagatggcttaagggctggtgggagtatagtgctaggaatgaacgtcagcttgatatgctaagagcaaaatgagagcagcaaagtccactttgtgaagttatggagctaattgctcataatactgtatcagtgccagtgggcctccagcattcactagcaatatcacatgaattgcatactctagtacttttgtttacttctttccttttactacctgccagtctggctttgtctttctagactctagaagatgtaaatggtatcacttccttgcaggtgtagccaagaagatcctggttatcattctcttcctacagtccattttccttatagtttttacttttctttttgattaggaccttatcacacctaaaacaacatatgcactggtaagattgaagactttgagctctaagttttagttattttctatctctttggatgttcagatatactaatttgattaaagaaaggaaagtgggaaaatggtagaaaggaagaacagctgcctgctaggggttttctctttcaagttaaacaaaaatgaacatgcaaaccaaataatcattatcccaaagtaagaaaaggggtacaacccaatgtcataagtctcaaaaattaggagcaagacagaattctgaagccaacccaggaggaatggtcaagcatgatgagcctgctagccccacctatgttcctaaagtacagtactatccacttggtaaaaatgctgagaattattactaatatccttatatatgaaaagaaacttagtacatattcttacctgttcccactgaaaactgaagagtagtggaaatggctataggagaaaaaaatatatgtaatagaaacagacaacgggactgagaatcaaaagaaaagtcaccaggagcacatggattcccctccattgccttgggatgttctctttaaccaggcagggtgacttctggaataggacacttaacaaagcttcaggaataagacacagtccagatagctaaatgaagcttacccatagccttgacacagctcttgatgtcttccctccatttcctgaacatattctgccatctctgaagctacagaaaaaaagtgtatagaactcaaaatattacacaattaaaccgtagctaattctaggtggcaagaagtcaacgaaactgtgtctgaacaattaggaactctggacagagatgcctgagtgtaagcaaggtaaaagggaatgacatggcaatacaaatgcaaagcaacagaacaataaagttaaaaaaaggaaaaaaagcttagaaaagtcaaataattcgatctagagaaaaagcaaaagaacagaaaatttcccgtgagctacattctatggctcaatttgcattattgaatgactcaagaaaaattgaattcatgtcacaagaactcaaagaaaaaaaaaaaacaaattatctgaaaggaaaagggagattgtagactaaaggcaaaaaaaaaaaaaaaaaaaaaaaaaaggaaagccaaaacaatgtgatcacataactaatttgaaataattagtaacaacagggggtggaaaagatatggctaaaaattgaaatattgccagagggaaagtgctgaagatatcgcagttaatgctgatgaaaaaaaccagagattaaattaatcacagagaaactgagatataaagagggcagatggtataattagatccctgaaagagaaaacctaagtacttcaacaaagaaattactcaaaggtatcaaactggaaagttttcttaatataaagaactgactctgaagtttgaaagagcatgttaagttgtaagaaaactacacagtatgttcaatgctaagatgtgcattgatcaagtcattggacttcaaggattaaaataatatccttaaggcatataagcaaaatttacagcacttatcacctatgaggtagattgctggcattatacaatctcattacacaaaacaatgtctataaaattgagcataaaatcaagtgggacaagaattatctgcaaccataatgtaactcaaatgtaaacagcaccagcagacattcacaaatacgaacaaactttggtaatataacactaaagagttcttttttaaaaagttgttaccatataataacaatataacacagatgagctctttttaaaaatgttgttaccatacaataacttaacagtacattttaaaataatttaaagagtgtaattggattgtttgtaattcaaaggataaatgcttgaggggatggataccccattctccatgatgtgcttatttcacattgcatgcctgtatcaaaatatctcatgtactccataaatatatacacctatattatttacataatcattaattatgtactcacaaaaataaaaaacaacctgggtaaactaacttatttttaacttgaatctatactccccccaaaaaataaaagacattacaataaaattcaagcatttaaaagaaaataaagttactcagaaatggaaacacttggtgagaacagtgacggcatttaaatatgcaagaaatacatggtacacattataaatatagaacaaagtatacatgtgtcagaggtcccccaaaccaccctcaatctgcatcactctctagaaggactcataggacccagaaatgagaatgtttatgagtatggtttattacagcaaaagttacagagtaaaatcagcaatggaaaaaggcgcatgggggcaaagtctggaggaaaccaggcacaggtttccaagagtcctctcccagttaaatcacaaaggatgttcctaatttctccagcagtgatgtgtggcaacacacatgaagtgttgtcaaccagggaagcaaccctggagtccagggtttttaccggaggtcagtcacataggcatacgatgcttacatgactgacttagttaccgaggctccagaccccagagggaaagcaagtgttcatcataaattatattcttagcatgaactatctagaccaactggtacagtctgactcaaggccctaggcttgcaaaaacactcttaccactcagaaattccatgagctcaatacacaggagctggtgaagggccagtcgtgcaaataggcctttcttgggagtgcacagtttgaacaactcagatcttttgagttaaccctttcttacacaatatgtgataaaaatagcaaaaaatcatagatgaaggagaaaatgtcaaagaataatgttctcatttttcataggaataaggcagttttactgggtaaatttgcaggagggagttcaaataataacaccagactgggcatggtggctcaaacccgtaatcacaacactttgggaggccgaggcgggtagatcacccgagaggtcaggagtttgagaccagcctgaccaacatgggaaaccccgtctctactaaaaatacaaaaattagccgggtgtggtggcatgtgcctgtagttccagctactcaggaggctgaggctcaagaattgcttgaacctgggagacgaaggttgcagtgagccaagattgcgccactgtactcccacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtgagctatgattgtgccactgcactccagcctgtgtaacagagcaagactctgtctcaaaaaaagaaaaaagttcttaatttgatatttgatttttctttgaaaagggaggaggataatgaaagaccgaggaaatcataactctctgagacaagtttaacacagactgggaagggtggcttttatttttaagggaatttaagcatcgtacagataaaagaaacatacataaaaaagtaaatactatgattttctttctccctggattgctcctttaacacaataattttacagaaacctttttccattgtaagtattattatattgctcaattttccagtgccaatcccttcctttatttggaggagcctctgaatgccagtggggagatagttttcctcttactggtcagaggatggaaatttagagagaagtcattgattattgagattgaaaagcaatcagacaataagtaaacaatcagacagtaaaagcaaaaattggtactaaaatgtgttttaaaatgacacaatgattaaataaaattaattatatcctctagaaatagaaatgggcttactatgacaaatacagatatataccatttgggactaagaaaaattttatgaagaaaggtatgtgaaatatttttaatagccaaaaatagaggaactctggaatgggtgggaaaggagtgagcttagcagaccttctctgtgaaacaatcgtttagctggtgaaaattattaaaacatacacacacaaaagaagctaagacacacacatttaaaaaattgtcataaggacacacagcaaatggaaaaacatttattcaagacatctattaaataccagttagaaaaatgagaggtgtgatatttaaactgtaaccagctgccatccgctagctcacccctgctccttgttttggaagccaaaaggacaagagctttcttacctgccagttatcagtctagggctacagttcaaccccagaagaggcaggctactggtgcctctcattttccccagattcatgttgcagaagcggtattatgggtaggcatagccaagaacattgggctcacttcttttatccagcccccgtttatagggtataagctctataccaattgtggcagaccaataataatgcgtgtccaattgtctcttcctcagcttgcttataaggcagaggttccatgctgggaagggcaagctgaaaaggccagagtccaccatctttcccaaattcccacttatacaatggtagtgtcactcgggtggaagtgggccgctatttgtgcaaccaactgggctgtaatggcacagaaattctgcccagggatagatgcagagtgtcacaataagagtttccactctgcctggagtcactgactatctggaacagaagttagagaagttcatggctaagggttttcttaaacaatggagatcttgatggcaagcagcttatagggagcaggcagctctatgataccagcagcaatgagcaaactggtaaagcagccagaagtcgagtagagagaatcagggaatgagaaagccctgaagagccctctggggatcacacttatccctgagggtatggaaagttgtacatatttgcaaggctacacaactcagaggtaattagagtaagacacagggcagatttgaaagcattctcaagccatacacagatgcctcatccaggaggaagagtcttattggttcagaaggcttaaacgtgatctctcaaccaacactggctgaacaataaggtactcttactcaggtgctattcctaggaaaacaaacttaaaaacaaaatcgttcattcttggtggtctggaagactgtatttattctgaaggctgaaacatctcaagggtgacaggaggataatttctaagctaacagtcctttgctgaacatgaggcaagatcataaacttcctcaaagcagtctccaagtcacacatatacaacagacaaagggcaaaaatctaactgaccaagggggcttaagtacagtatttgatcaataagttacttatattgatacactcacaggaaggcaagccaaaagataaaaacaggggaacctttctgaggggggagacgagagccgtctgccgaaaatatacaagtctcagaattatctctatcaaatcactaaataaatgaacatatgaacaaacaattagaaataaacctagaggaacagggttagtgtccagacttgttacaatgtattatctaaagtccagctttcaataaaaaattaggagaatgcaaataaacaggaaatgtgacccatacacagaaataaatgcaggcaatagaaactgcctttgagtgggctcatatgttggacttaatagacaaagaatacaagtaactattataaatatgttcaaataactaaaggaaattatgcttaaaaattaaaggagaatgagaacaatgattcatcaagtagataataaaataatgaaattttaatacatattgtatatgtctattcatctatcttccaatagaaattttagagttgaaaagtccaaaaacctaaatgaaaaattcactagacgagctcaatggtagattagagttggcagaagataaaataattgtattagtctgttctcatactaccgataaaggcatacccgagactgggtgattggtatgaaaaaagaggtttaatggactcacaattccatgtgactgggatgcctcacaatcatattggaaggtaaaaggcacctcttacatggtggcagacaagagagaaaatgagagccaggcaaaaggggtttcctcctataaaaccatcagattttgtgagacttattcactatgatgagtagagtatgggggaaactgcccccaggattcaattatctcccaccaggtccctcccacagatgcgggaattatgagagctacaactcaagatgagatttgggtagaaacacagctaacccatatcattccatccctgacccctcccaaatcttatgtcctcacatttcaaaaccagtcatgctttcccaacagtcccccaaagtcttaactcatttcagcattaactcaaaagtccacagtccaaagtctcatctgagacaaggcaagtctcttctgcctatgagcctgtaaaatcaaaagcaagttagttacttcctaaatatattcagggtacaggcattgcataaatatagccattccaaaggggagaaattggccaaaacaaaggggctacaggctccattcaagtcccaaatccagtaagtcggtcattaaaccttaaagttccaaaatgatctcctttgactccatatctcacatctgggtaatgctgatgcaagaggtgggttcccatggctttgggcagctccacccctgtgggtttgcagagtacaattcctctcctggcagctttcatgggctggttttgagtttgtatggcttttctaggtgcacagtgcaagctgtcagtggatttaccattctggggtctggaggacagtggccttcttctcacggctccactaggcagtgccccagtggggactctgtgtgggggctcacaccccacatttcccttcggcactgccctagcagaggctctccatgagggctctgcccctggagcccatctctgcctagacatccaggcatttccatacatcctctgaaatctaggtggaggctcccaaacctcagttcttgacttccgtgtacccacatgctcaatatcacatggaagctgccaaggcttggggcttgaaccatctgaagccacggcctgagctctaccttggccccttttagccatagcgtgagtggttgggacacagggcaccaagtccctaggctgcacacagcgaggggtttgggggtgtggctcagccacaaacaaaaccattgtttcctcctagcttctggggcacctgcagttggagaggctgccataaaggtctctgacataccctggaaatatttgcctcattgtcttggcgattaacatttggccccttattacttatgtaaatttatgcagctggcttgaatttctcctcagaaagtgggtttttcttttctatcacattgtcaggctgcaacttttttggacctttgtgttctattttccttttaaaactgaatgcttttaatgacaccgaagttacctcttgaatcctttgctgcttagaaatttcttccaccagttaccctaaatcatctccctcaagttcaaagttcaacaaatctctagggcatggaacaaaatgctgccagtctatttgctaaaacatagctagagtcatctttactccagttcccaaaaagttcttcattccatctgagaccatctcagcctgaatttcattgtcagcattttggtgaaagccattcaacaggtctctaggaagttccaaactttcccatgtttttctgtcttttcctgagccctccaaactgttccaacttctgcctgttacccagttccaaagttgcttccacattttcaggtatctttacagcagtgcctcactcccagtactaatttactgtattagtccattttcatgctgctgataaagatgtaccagagactggataatttataaagaaaaatatgtttcatggattcacagttccatgtggctggggacacctcacaatcacaatcatggcggaagtcaaaaggcctgtcttatatcatggtagacaagagagaaaatgagagctaagcgaaaggggtttttcgttataaaaccatcagatcttatgagacttattcactaccatgagagcagtatgggggaaactgcccccatgattcaattatttcccacagggtccctcccccaatatgtgggaattattggaactacaattcaagatgaggttggggcggggacacagccaaatcatatcaataatcaaacttgaaaatagaacaatagagattatgcaatctgaatagaagaaataaaaattttgtatatttataatatataactttaatgaatggcgtgtttgtatatgcgtgcacatacaaacacaagaacttccatcatgaagcattatggatgtgctttggtgcttggaagcatgggtgtgctccaggcatagctctatgacaatttggcaggactgttaagtatacagctgggagaatcagaccgcctgcatgcaactcccagttctgccatttattagccatgttacttgatatctagaaaatgagataataaagtcttcatggtgttcttgaagattaaatgacttcttaatgcatataaagtcctagaaagcaccaggcgaatagtaaatgctcaattttaggtatcattattgatcttctttagattctgcccttccaggagataaaagatttgttttgttttgcttcacatctggatcatgtgttaaatttagattgtttccaatctaagaagagatcttcataatatgtcttattgtaacggtgtttgcaactgtcacacttttatctgtaatcgctttatagtttgcaaattgtaatgtgcagctgttagcatgtcatgagttttacctgggagatggctgattttcaggactatcataagtgcatttatattacttttcatcttttgtgtggtatctgaacagagtagggatatgataacaacacagactattttgggacccttcaatgtggtctgcctgactcttgtttctccctgtttcacttctttctagatatgagggtacgggtgtttttctcttttgttcactgttacgtctatcacctagaatagtgcctggcaatcagtaagcacagaagaatatatcatggtatctcataatctaaaaccatttactttccagtagatgcccaagtcctttgattttattccggtctcaaactaccttacatgataaccattttaaaaattatatgtctgatgctgtattagcctgttttcacaccgctctaaagaaatacatgaggccgggcgcagtggctcacgcctgtaatcccagcactttgggaggccaaggagggcggatcaagaggtcatgagattgaggccatcctggctaacacgatgaaaccctatctctactaaaaatacaaaaaattagccgcacatggtggcaggtgcctgtagtcccagctacttgcaaggctgaagcaagagaatggcatgaacctgggaggcggagcttgcagtgagccgagatcgcgctacagcactccagcctggatgacagagtgagactccgtctcaaaaaaaagaaaagaaatacatgagactggtaatttataaaggaaagaagtttaattgactcacagttctgcatggcttgggaggcctcaggaaacttacaatctgatggaaagggaagctggcatctttttcacaaggcggcaggagagaaaagagcatgtgaagggaggaactgtcaaacacttacaaaaccatcagatagtgtgagaactcatgagaacagcatgggggaaaccacccccatgatccaattatctcccactaggcccctccttcgacacatagggattatgaaaattacaatttgagatgagatttgggtggggacacagagccaaaccacatcagatgtttctgttaaattgaatagtttgttataatctgagcatcctccttctttctttcctttatgtctatagagatactacctgatctacctgttcaatatgatgccattgcttctttcattacaaaccctacccatctaccaagaccaacacagactctatcccatctgccttaattgccttcatccttcagcttccctcctctgaatgttacttgctttgtatttatttcctgtgtcatttaaccacttgtatgttccagtacagttacttgtgcattctgtgtctccctttagaacagggaccttgtctgtttcacctttgtattctccatagtgcatgtaggtagcaaatatttgacaacagccaatatttaataaagacctactcagtgacagatactgaacccaatgactggtttgattcctaggaatgtgagtgatattctcttcctgtgttttctaaaattatttgcctagtgaatatttaaacaaattcacatgttgaacatcatagtgtttcaaaacagcccctggacttggtatcagatatattgagtcaaatccagagatgctgtgtgactttgggatgataacatacccctttaagagtcttggttttcccaaacaccacatgttctcactcataggtgggaactgaacaatgagaacacatggacacaggaaggggaacatcacacactggggcctgttgtggggtggcgggaggtgggagggatagcattaggagatatacctaatgttaaatgacgagtcaatgggtgcagcacaccaacatggcacatgtatacatatgtaactaacctgcacgttgtgcacatgtaccctaaaacttaaagtataataataataaaaaaagtcttggttttcttgtctgcaagtaggaataatagaatcacactatagtgttaatcgaggtaacaaattgtcggtaacctcagactgaggaaggtatcaaataaaagtgagttttcagccaggcgcagtgggctcacgtttgtaatcccagcactttgggaggccaaggtgggtggattgtttgaggtcaggagttcaagaccagcctgggcaacatggcaaaaacccatctctacaaaatatctaaaaatcagctgggcatggtggcatgcgcctgtaatcccagctgctcggtaggctgaggcaggagaattgcttgaaccagggaggcagaggctgcagtgagcgaagatcacactgctgcactccagcctaggcaacagagtgagactgtctcaaaaaaataaaaaataaaaataagtcagttttcctctttccctatttgaataaaagtaaaatgagtttttcaagggtgtcattagctttatgttattgttctaactctgcctctatcagatattctttgaatgggccaaactctcacaatggctggacactggggatgttatgatgccagaccatgctgctactttttccttcctttaaaagctctctggtaaatatcgatttgtctgctctggtggttataaactgctgctctcctcctattcttcatgaaatacagggattctaagttttgttttatgtacttgtgttttatctatcgcatacagaattgcaaacaatactatttgtgaggggcgttttgactttttcaaaatatcttcatatccattatttaatttggtacccttcacaagtctatgagcctggtagggcaggtacctgtgtcatcataatccccttacaaatgaggaaatagagcctcagaggttaagtggtctgcccagcgtcacacagattaaaaggtggtaacaacaagggttcatcaaacacaagtcactaggctacaaatctggcaccctctctactcgcttagcctgaaagcaaaggggtatttggcaactgtgacatccgtcatcctaacgatcttctccattcttctttggcagaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggtatcgtatgaagtaccctctgccacttcgtttgggcttgtcttccctttcttttctgattttcattggtttgattgaattctttgtttgtttcttgaaagttagctgctcacctcttgtttaacagacccaggataaaacccaacagcagcgatcaccttctccttgtttctgcatgaggttttgatgtcaatttctggtttctgacagtggtgatttctttactagattatttgttttctaagtttcctttcttggttttttggaatcgtttagctttgtgtaaaacacgctactttggtccatcttttgatcaatcatattcccataagtccaactcctcagtcaccactcaaaacagtcacagctgaggtcagggacagggcaggaagtggaggcaaaatgttgatggtggggttgtaggaaattaaactttgtgggtagggtgagaagtacattgtttctagctccacagctactattcaaatggagaattctggtggccttgatgacactgatatctcctttgactttctcctagagggaggacaagtagattgttgttcccttggaaaataattccctaagttgagtctgtgacacgtggaaggaaaatgtgtctcctgatacgtatacccatttttcttcttgacattcttaaccatcactcagcatccccttgtgcaaagattgttaccttgtactatcactcactaataactctcttcttcttatataatacatatctattttacctcagagttgaaaaattatgacttcaaatttgtggctttattggaataggattttctctttcattgtaattacctataacagaatctttagaaattttcctttatatggcctcatattctcttctgctattgacctttactgaattctaattgatattctatagagattgggatcctcttggtttttggcaaggaaaaaacaaacaaacactccatttctgctgtttctaatcagcagaaagtcaatacccagcattgataagattagtgagacagctgggtccaaactttctaagctagtgaatgtatttgggtacgtagaatatgtttggatacagtgataccttataaagatttcagtgaaatggtttgtcagagccatggagaaaaaatgatgaacaaatgtaccagatgcaagatcatatgtaggcccacatgtcctggtgggaaggtggggtttttgaatccataccaatcttatctgctgtcaggtcaactggacacacttggaaaatgcctacatcataaacctaaaatctctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccatccctgcaccatcctacccaccttaaatcaatataagagtgtgttacctaaaaccaacagccagcagctgattatctcctcagaaaaaaacaacagaaaaaaaaaaaaaacagaaccaaatacaaccccataactagctcactgaaaaagatgatgaagacaatttttatctctggatctatttcaaagtcagagagagacaaacatatgagaatgattcagccccacgcgatcctgagggagtgtacacagtgtcattaaacagacatttttttccccattaggtgttgtttagtaaagattagagtgtcaactttgacaggtctcacatcttagaaggaaaaactggggtcagtgggggtacaaataaaagcgtataagaaataaggaaataagtgtacagattctcattctctctctcacacacacacacatacaccttgagttggtcatacatcccacatgcatttctagaagcattatttttgtattttaaactctagtcaaagtctgagagatgtgcttttccaatagactttgctttttttttttttttttcccctttggcttcttttgttgcaatttcaatctagctcctgctgcgttgaaccatctcaggcaaaggagaggtagcctctctgtagagagcactgtgcttgtccagaagccatagttaattttttttacaccaaaggataggttcatcataattactggtttgaatttatttaactttctttccaacctgacatggaaaactgaacttaaactctcatgcttgtgtaaatgcagctcttcatatccacgccttgtttaaaggttttccttccgttccctccccaaaatatacccctttgcaaatattttctttctctttgccgtgaatttgtgtttcatttttctcaattacagaagaaaatgtatccaagtagaatttgtcttcacatgcattccaccaaaattaatttcaaatgatcactttgctccctcactctattcaagttgtgtcttttttctagcccatgcactaacaatattttagtttatttcaaattgatcacacatatgcattcatgatataaaagcctagtatatatttctctgatgtaacatatcttccaaatgtcaaggagactagggttttccaatggctttatcttctgcaggcagccatatgtggtgctaacaggtatgagaaatatcctataactcagcacaacttttaaaaagttgagaggttgactattgatcaaccatattttgattctttagaattataagctataacattttattattacagcatatttaaagatttaaaagaccttatcttattttaatctcatgatctcatggatctcatgcgattaatgataatctcatgataattttgtgagataaatcaagcaagtgtttttatgcttacttttacagatgtgtagcacagagagaaatatattacttttcaaagcttacataaaaagttggagacagagctggaactagaacccatgtctctaaactgctagatcagcctgcgttatttgtttccttcacagatcagcactatgggtcaatgatgtgttagtcttaatggcttccaattgtttttatgatggtcacctttgaaacacacacagagagaatctccattttcctcagtgcccagtttgaattgagctgcactagggaaaagacagttgatatggacaaaacctttaaaagatccttagcagagtgccaggagcccttcttcaatggcagactctgagggagtggcatgtagtttggtaaattgcatttgaattctccagatgttctctctctggaaatgtggacttgctattactgtttaccaaacacattattgaagacacacagctcttagaaacatttacctcttccatgctcgacccaaagctcaacaacgagaaaaactttcttggccaggcaccttaatctaattacagacacttaggcctgtaatcccagctctttgggaggccgaggcagcccatcacgaggtcaggagaccagcctggccaacatggtgaaacctcatctctactaaaatacaaaaattacctgggcttggtggtgcgtgcctgtgatcccagctactcgagaggctgaggcaggagaatcgcttgaacacaggaggtggaggttgcagtgagccgagatctcaccattgcactcaaacctgggcaataaagtgagattctgtctcaaaaaaaaaaaaaaaaaaaaagaaagaaaagaaaaagaaagagaaagaaagaaaaaaactttctatcatttaccataatttaaaacaaaacaaaattaaaacaggcaacacacagatatgaacacatacacatcaaaagatatgccaagacttaggcagacttttttcaagcaaaaagtctggctgctaccaaacgtagatttaaaggaaattgccttcccaactcagttctttgactcatattttttatttaaaaaaccacatatataaatgtgtatgtgtgcgtgtgtctatatacacacgcacacacacacatatttatacatatatacatacacattcagtaacaagaacaccccctcagagcctatcaagaaggctctgggatagattttccttctcaaaccacttgttcttcaggtaaaataacaaagtaattcttcacatattgaggtaaagtaaacaaactgtctgccatcttgaaagcgccaagctcttacattggtttaaagaccgcatccactttacatgaaatcatttgagtgatccagaaagatgagcccaagccaccacctctcactaggccagcttcttgtctaataataaaatcctcagctatgcagaagccgaagacaaaacccacttgttgtttgcagtccttgggtttgttgctttaggctcactcttcctctcataagcgtgcccatacaccagtttcctctctctctttaatatgtcaggaagggacatttctccagctttgggtgatggtaggtgcagtcagtagctgaagccatcacctcttcctccctccctgccctccctccttccagtcctcaccaggggcatggcctcctctgtctggtaatcataccggttgctccagggctgtttgctcccacttttctgttgcggttgacgacacatgacaaacctaaccgcacgaaaccaaacccagatttttctcaagagatgttcttctcgggaacaaataagcattctgcctccttactcagaataactgggtgctataaatcgctcctctccagatttcacgtagcttcattctcccctttattcttgctcctttaaaatgattcactttggggaattcaaatggtggcatcatccttgacaagtcctctaaaaactactgggtcaaccttaagcagaagaagagtactttgtgactatattttcccctctatctttcttcctttaaaaaaaaaatcatttcgcttctaccttttagtatctaacggtaaacaaatccttattggaatttccaccatgataaaccaaccttaggctgaaccgggcagcttggtaacaactaacctgagacctttctctgaccttttctgcccagtcccctactatgcccactgattctactcaaggacttctatgttgtgtgtccatgactcccaagcagagattaatacaatgatagatatgctgatctctggcacagaataccttgtctgattactagctctggccagttggtcactcttttcttccctccctttcccatttaaaaaagtgaaacaaaaaccaaaaaattttctctcctcaagatgtggaatcacagagtgaaaaatactcaagatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatcactagcaatcagagaacccaattcattgtgataacatcatacaactcctttgaccctacacccgaccccacctctctaaaatctgggatgggtgtttgtgcggttagctgtttgcaagtggccattttatgacaggaaatgaccaggtggtgttaaccctttccttaccactaaggaagatggcaagtgtgcctatgcaaatttctatagcatttggggcccaacctaaggagagggtggagggagtttgattttagaaaaagagaaagggttaagtacgtcactgagcaacttcatgggcagattttttaaatgatacaatcagtcagactggtgatatgtctttggaatactaatacaaaaattgtgttaatgctactttaaaaacgaattttaagaaaataaattatagaggaaaatagaatataacctgcatttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatatgtatccaactttactaaataatatactgtacatatacacccacccttaaacttgtacatactttatatatataaaatggccacatttcttacgtgtgtctgtccccggaagggtggactgattgtttttggatgtctgcagctgttaccttgaaggatgcaatttcatctttcatttatttttccccatctagactgtatcaggataaactgtaactccagtaagttttccctcaagtttcattttgttctttaaaaaaaaaaaacaaaactgactttattttgtttactgttttatgagctgttttttatttgaattattttttcttttaacaatggagtgggggggacctggggctaagaagatggggggctgggtgagggtgaagggctgagtgtggttttgggtgtggtttctgaagtgagggcaggtcctctcttctttccttgcatttgctctatatgaagaaaagaaggcaagggcacatgaataatgaaataatgaaaaatcaagttgaaatgatgatttattgtttttgggaggtaactctgagagtgaacaaaaagctttagggcaaccagcatgcacttctccactaccaaacagtttagaaaataaaagcactgttcttgacccacaggtggctgccaactctgacatttctttcccagtatttatctctgttgggaacttctagcaggtgggcagatcactgctattggtgataaggcaacactttaaccaaagacttgagacacactctgtctctgcaaaaggaagaactgcagtattattttcaccttatcccattcagataccctagttcttgaagaagggtcctaacaaggcacaggatgaaaactactcatgtatttcttcctcttccttagaagtaaacattagcttgagtcaacatgtagaaggggaatatgaagataaataggaagaataggcacaagagaaagaataggcctagatgatgaaaggaacaaaggaagaaatatgctttgagtactatagcatattatattaggcttattaatactaactactgtaacaagcaatcccaacattataatggctcaacaaaagaaggttttatttcttgttcagtcaaagtccaatgctaattggtcagttttcccagacagctctcttcaaagaggtaattcagggatctaggatccttccatgaggtgggtccaccacctcggagttctttacttctggctgtatccgtagggaagagagagagagagagagcttgggtggttgtgcagtaggttttattgccttgcctggaagtaacaaacatcgcttctatccatatttggtttgctagacatgactccatcctacatgcaaaggaagctgggaaatgtagtcggctagtgcacccaggagaagaaaaactggattagttgatatctagcacatgtaattctccatagtatctcatcatctttaaaattctttcctcactaggaaaaatccaacttttacatttggtttacttgttgattccatcctagtaagtcttttataggtgctagtttaaacttctttcttggtagaagatatattataggcatgacaaactaataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcaccacaatcacattttagaacatttccatcatccccaagatttcttttctggtcatttgtagctaatccctgctcctacccatcgtcctaggtaactattggtgtgctttgttccaataaatatgccttttttggacattttatgtacatggaattagacaaattgttatatagtcattgtatcttgcttcttcaaaaaattttaatggcatttctatggaaatattttctctttccttttgcattggttttcagaaggaaataaggtggaaacccagcatgaaggtggaaagcctcgtatccgaagctacatctagcatcttctagcttcagagacttatttggagaacagggaactgaggcagttatttaatcaggatatcagaatttgcttttgctgttctatccacactttctcatgaagtcaatcccatatattccacatgatcagccacggaaagtcatcataagacaactcccaggattacctctgttgggaagatggtgacacagatgacagcaggttttcttaatctgataaaatattttctatttacaccccaccaaaaacagcattgagaggaaaatatgtcagcaaagttatattcccagctttgatcacaaagtatagaaagaatataactgatttcaattcaatacttacataaagaatcaagattagattttggaaattgtttttgagattttcacaataaacctttaatgtactaagaacatttattttgttggaaatttaatatcagagaaataatacagtgctcaatggttgaccagtgtttgactggaaaaaacaaatatacatgggtcttttaaactaatctaacacctttagagctaaacaatgtaaccacgtatctagggttatgtagagtcacaaagtaaatataatacattttttttctgaagctaattttaattgttaatatggagtaaaagtttaaattgaaaccaagttgatatattatgcagaagaatgcaaataagcataaatctttaagaaaaaaacataagaattcaaagacatttcatttttattgtgaatcttctctatttcatccctggtattattggcatttgagtggaaaagtttgagaagactatgcaattaaatttggagagaaaaagggcctacatgatccgaacttctaagcccctcttcttattgactccatgtcagatttcatagcttgacctgttacaggatctcacattgtctctgtaataggtgtgccggtccttactcttatctgattttcaactgtgagagtatttgcaccctgggtttgagggagaggaggttttccctgagccttacctcttgctgctatttcaatagaagtcatagggtaccttgcttaattttcaaaacagagcttcttttttttttcccccttgaagggaaatactgaattaaatttgaatcaaggtggattataagtttgtgaactttttcagtcattcttttttagaatgcctgtcctctgaaaagtcacttgggtaaaatactgaatgacatcagctatttttttttcctgttcatctgctataaaatgttgtttgttctgggaaatggctatttccaaggcattctgtgacactctttaatggagacaagagcatgaaaaagaaggatgatcttccagcatcgagagaaatcaatgggccatgagagagaagggtgatcttgaggggaaaaaaagcagttttcttctagccttcttccttttggcttcacttcctggcccttttgtcagagactatggcccagttccatgccaagtatttcctcccaagaagaaaagcaattttctaatcagctcttctttctgcctttcttaacttctcttttttaatactttgtctttcctcatggtatctatgatatattcattattattcattacaaatcctactactcctgctttccaaatcctccaagaataccacaccataaattgctctctagttactatcaataaacatatattacagagtgtgtaaatcaaggtctttggttgaatcaagtttgttgctgaatttgattcatctggcgggaatgtatttcttaatacacttaatacatatagttctagcttagaatttatttttaaattgcaaaagaacaacagagttggcagccatcatggcgaattgaactacagggtgacctggaacactactaaaggaaaacagaactggccggatgtggtagctcacacctgtaatgccagcactttgggaggccgaggtaggcagattacgaggtcaagggatcgagaccatcctggccaacatggtgaaaccccatttctactaaaaatacaaaaattagccgggtgtggtggtgtgcacctgtagtcccagctactcgggaggctgaggcaggagaatcgcttgaatccaggaggcggaggttgcagtgtgctgagattgtgccactgcactccagcctggcgactgagcgagactccatctcaaaaacaaaaacaaaaacaaaagcaaaaagaaccagggctgttttctggagaatttctggaggaaatgtcctgttcctatggctgtagttccataaggctggcagtaacctaagaggcacgcggttctgaaaacaggtatgaacttctcgttggtgtcatgagtgcgcaagtgaaagtatggaaaatgactttttgtctttgaccttgtctgattgtgcctttccctgtgatttcctagccactaatttattctatccctttcaagccatgtgcagtatgaatgaatatagagaactaataataattaaatatatggatagcttgaatgaatacagtaaacacatattaatgaatttcaactttttctttctttttctatttctctttcctctcaaacgctaattcttctgtgttgtggccatcttcattatctttctaaaatggagtgtatatgtggcatggaaattgtgagtttgtgtataagcctgattatttaggtatatgtaacagtgtctctctcactaattactttgaacctgaagacccactaatttctctgtgacaaggtttattttttcttcttagacacagaggagaaaggaagtagtgtgctgtacaaaaatatattgaccttaagacacttaagtgccacaatagagttatttgtgtcagagaatagctttgatgatcttgtgtattccctatataagctgatacctttgattcatcatagaggtgcacagtaatctcagagatgtatgaaaataacatcacaaggatatgatatctgcaaattttatctcccaagactactagtgtttgagtctttctcctcttggacttgcttggataatttgtttctttcttttttttttttttttttttttgccttttcccttagcttctctgccttaagtttctaagcagactccatttccagtgctttggaaaaattaacagcatgtgggtggttattgcttaatttaggcatagtttagtgagctgcagtttattatactggacttatggttttcttctctttcttttactctgtctttcctctccatggtacaagaatatgttatttcatctttacgaatcgtttatctgagaatctcagagccaaattgtttagctctttcctttaactcagaaactcttgcctcagaccaataaggagggctgacttcttcatcactaaaagtcattctcaaaggaaattgtagaaccctctttggtatccattttaaaagtcaagtaatcattactgtcagccatttacctggtgatgccacttattagaatcttagcagagatggaaaagcaagagcctatgtatcataatgtattctctgtcaaactataagcaagctataagcattgcacttcagagtttctatcttcataacgcatatttttgcttcttttggtatgttttatatttcttgtaacatatagaacacttcaagtgtaacaatatttatcgtatcaataacagccagattttagtatgatagtgggatgcttcctaaatatataatattaaacacttcttaataaatattaattcagattggtttattttaaaatagttaataagattatacatggaacaaaaggcaaaatagtaaaaattcttcccactcatcgtattcctcaaactccttttcccaaaggcaaccaaatttattagggatttttgtatcttctttcaggggtagcctatgagtatacaacatataattatatccacgttcttctccttttcttctttctgctcctccttctttttgacacaaataccaacaagcttttccacatcttatttttccactaaaaatgtcttagagactattccatgtaagaatatataggtttattttattccgtctaatagccacataacatttcattttaggggggtgctatattttattaaatcagcaccgtacatttaaatttttctcagctttttactactaaaaatgtaagaagtatatacttttgttcattagttaatgcatacatgtataagaagatctattggataaattcctaaaagtagaactgctgagtcaaaagataagtgcattataaatattgatatatattaccaaattgcactccaaagaggttttacaaagttatatttctaccagcaatatatgtgtttgcttctcctcactcttgtaacacacatcatattatcaaactgtattttcattctcttaagatagcttttcaaaatgttgctgtcacatatttatttcccatagatcttttcctcccatcctttaacatcttcaaatatacatagggatcattgtcattcatgactttggtgacaacttatatcagaaatcttttaatagcaatctgctgtagcaacatttcatatgttaatcttgttttgataaacagggatattgtagaaaagtagcaatatgttatagtaattttgtgtaatttatctcctacattattattgatctgtgttgggatctcagcacagacaggcatttagtgcaattacaaagagcaaggaggacactggagccaaatagcctgggttcaacacttgtctatgccacaaatgagctacatgtctttgacaagttgcttcaactcttagtttcctcaattgtaagtttcatatgaaatttagaaagaataaagggaatgggatctagcaccaaattaaaaagtaaacgtgatgtgaacttgaggcattaaattacaaataagtggtttccaaaagagagtatgctttgtctcatcaaaggaagaagcagaggaaacagcaaaagaggaggagaaaaagaacttgttcaaagcacaagccttcataagttatgtcttagtccatttggtgttgctatgatagaatacttggggctaggtaatttataaagataagaggattatttggctcttgattctggtggctgaaagtttcaagagcgggcagttgcatttggcgagggcttcatgctgcttccactcatggaggaagacagaaggggaggtagtatgtgcaaaaagatcacttggtgagagaggaagcaagagagagaaaccaaagaatatagactctttttaacaacccactctaaagggtactgatctattcccatgtacaaagagaagtcactaacccctgcctgagggcattaatctatttatgagggattcaccccgtgactcaaacgcctcccactgagcactgccaccacaaaaaaaaaggaagcaaatttcaacatgagttttggggggaacataccatatccaaaccatagcaagatatatggatataaacaaagttaatagagctgctgaattctaggaaggattgctagacaaaggaataaatttttaatatctgaacatcttaaaataggcaaatacccagccaatgtagaaattttatattgttaaatatcaggttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaaggaagatgaacgtgtatctgtaaatattgcatgttgtcattcttccttgttcttcctcattcacttattccatggacatttactgagagtaagcagagttccaagagctgagtgtcattttaggaatttatactgcaaatttccaaggaaaatgtaggaggaattctcatagactgagtaatttctttatcccaccctactcttccctttcacattgcccacctccatttcttgtttttcttgaagaaattggacctcagatgtatgtatctctaaaatccagatgagtctcttatggattttgttcagggctaattcaacattcaattcaacataatgatgtcttttttcacaatgtgtgtgcatttctcatgatggggccctaaatgctggtttacttagggattttcctgatttccttttttgttttgatttgccctccttcatctgaccacttgcttggagcctcgcaagctgtgtttctgctcccctttaaaaggctgatgtttcagggactgtaattttagtaaaaatactatttctgttttccttctacctttccaagatttctttatgtactccaatccattttatgtgtctaattgctatagtcagatatacaaggtgacaaattctgtaagtacagttggtcctccataactgctggttctgcatctgcagattcaactaacaaaaaaattgaaaataattttaaaaaacaataaaaaaccaatataacaatagaaaataatacaaataaaaatacatataacagctatttgcatagcatgtacattgtgttaaatattataagtaatttagagattagagtataggaggatgtacatagtttatatgcacataatataagacaccattttatataaggaacttaagcatctacaaattttggtattcacaagggtcctggaactaatttctcatggacaccaaattaggaccgtattagtttcaggcacagtttatattttgaaaattaggaggtattatggtaaatttaaatggaaactgggcctgagaaatccctgagcagaacaaagccagttaggccgcataaatgaccttaaccttgctggatttgcaaataagagcaaaagttaatttgagctacagctcataaatacctatattcagagaaaacagaatgtaagctcaaccaatcagaagcagccaacaaatttataattatataactagggactttccaataggataggccaaataaggcaacagtgtaactgtaatccatcaaatattttctttgctttactcgcctatttatcctataaaagcctgctatttgcattccctcagtggagctcctgagccacttttgatttagagcttccctgtccaattcatgaatcactgtttgttaataaagtccttaaaatttttattgtgcctcagtttatcttttaaccgtttgacctctatgcggtgtaggatgtacagtgaccatttggtaagctaatattattaacctaaattctttattcttgtttggtaacaagataaatgtattaatggatgtatttccctttcattatgcctaatatatataaattatatgtataaagtacatatatacatatatatatatataaattgcagttgtttttatgcatatcataaaagataatataatttgaattctggagtttccagaataattagccacaaaatgaaagtctgtttactgattcaaagcatctcaggaaacacagtttccaattttgggaagaaaactttacagaccaggagatgttatttctaaaaaaaaaaaaaaaaaaaaatggagtaattttctggctgttctgttgacttactagaatcacatagctttttaactctgagtttatttgaagttagggaaataaaactaagaagactttatacatttccttctcaaaattaagctgtttcagaggaaatctgactatataatatctgttcagaaaatcattgtcatccccaagcctgtgccagccctctgtcagcagcactgtcctcaaagattcctcaagggaccctgtggaaaaatgaaaacaagagaggctatcaaggggtgcaagtaagaggtgcagtgttgagttataataatctaagtgtccttcctaaatggctgaaagtatattgcagtagaaaagtattaaaatgtgtatgtgtcccaaaaaagaggcaaaatgtaatggagatcatgtcctctaaagcaaaatatttggatggttatgaactcaggatcctccaataggcctgctggggcacatttcttttttaatatcaacatattacaaatggggaaaccaaggctcatggacactgagtgcttgacataaaatctcaaggtgatgaatggtaggcatgaacctttataaatttagttttataattcttcatcatatgagtactcttttgtcccctaaatcaagctgtctcttaatgatgacacaggactttgtttttaaaggattaatggggaaaaaagagggggatcactgcaaaggtaacgaattagaatatttttacctaaaccgatgaataggagtggaatgaaatttatttctgaaatccaggagatgacagagaaatgaaattggtgttatccacaagtgcgggcaggataaaatctaaagcaataaacagagggctgctcctctgttccagtataataaaaagtaatatttgaaacacaaaagcgagagagaggaagacctgcttatttcctgtgaggggttttcctgtgataggaggcacttttcttcctttcctccccagaatccgaggagaaggaactgccccactgaccagagtgacaatgcccataggactgaaggggtaagagcaacagaaacggaatgcttgaaaggagcagaaacagtgtatggcagcagcaaatgtgtgtcagatagaaagacaaagggaaagggacacaaagaagtattcacaatggagcaacacacatgtagtgtgttttataatgctggaaaaattctgtacctttcccatctcacagagaaaagagaacacaaaggaagatggataaaaaaaaaaaatgatgcagccactgggccggttatctctggctagagaaggattaccatttccttacaaaaagaaattgataattgaaattaaactcagattgcccaggtatacctgccggcagttggaatgtttaacttaactgctcggtttacttattgacaagcaaactcccttttactaatagaaccaatttacaaaactttccggtcatcataaatagaaaagccagatatggtaacaccgcgatgactagttaagtactcaggtacttatccatgactttgtttatccatcctcctacatatctgatagaaaacacaaggagtaggaatctcatggttaacatttcaaaggcatgaaaattgaatactaagtgaagatacaacttcattctttcccctcttcatatcttcctggaccctttttctcctttgtcacagcaaaataatataggctactaagtctatgcacaaggatatttacaataaacatttgacagtctttgctattgctatatgaagtgcatgcacttgacaggtggctactaattattatagtaaaaacaatagcattgagtgatttctgccattatgggataagaagtttgctggcattatcttatttaatcttcaccacaatcttataaggtaggtgtcattaccctcattttagaaatgagacttgttcatatggaggctgggtgtggtgtctcaggtctgtaatcccagcactttgggaggccgaggtgggtagatcacttgaggtcaggagttcgagaccatcctggccaacatggtgaaaccctgtctctgctaaaaatacaaaaattacccgggcatggctttggacacctgcaatcccagctacttgggaggctgaggcaggagaatcacttgaacctgggaggtggaggttacagtgagccgagatcgtgccactggactccagcctgggtaacagagcaagattctatctcaaaaaacaaaacaaacaaccaacaacaaaaacaaacaaaaaaaaaaaaaagaaaagaaagaaatgagacttagtcatatggaatgttttgcctagcttcagattcagtctactccattccaaagcctctgctcctcaccattgtacatattgcctctgccacttgtatgctgaagtgttaatgcctaaatgaatgaaatctatcactctagaacaagtgctgatggtcccatgaaagaggccacttctaatcactaatacctcctatctctgtaggtagtctttctgaagtcttgaccttccagagtcaagctccctcagctcagctctataggcatattagtgccccatgcttgccataaccagtctcgaaggcattgtctatttcagtgactgaaaggtacttggcatttagagatgcatagaagatgaattaggaattattattcaggaacagagacaactaagaagaggataacattagaatgccataattcaacttatgtttattactgatgaatcactctccacatgactgatgctttgttgaccttctcttggtaatgctggtactctctgtctcttatttccttccattgtactctagtcctctagtcttagccaacaggttgtggctgctgcaatccccgaggctcttctacgctacctctgtgtccatgctttgctgtgtgccctatagactgttcctctgtatctgcctttgcaacagctgtctgctcatccttcataacagctcaaggggttaccacctagatgaaaccttccttctactccaggcaggtctagctttttccacctttaagttctcctggcacttcgcacatctttcagaactcttatcacagttatatgctgtaaacaaagaatcatgggttttataaaattggaaaggagaactttatttctcataaagggttgcagcctgcaggctggccatcccagaggctgggaagcatagcctctggcaaaagctgagagcaagcacattgaggtgatcaggggtaaagggaacaggaatttatgctgagcagggtagctgaatatacatatttaatacactatagaaagagtcatgaatatttacggaggagaaccatgcaaatgtgcaattgagcttcatgcctcttcatgggttacacgttaaaaaaaaaatagctgtgttagcatgatctgagggtggagtttttggccctctgacatcaaaaagtaaaccagaggatatgaaaattgccagtgtatatcccccacaggtcagccaaaactggtccagagatggtggttggtttttaggaagggatgccttgtgaaactgattaactgtcacatcaatactgtaaagagggagagagagtctggttgtggcctcaggtgattggctaaagacaataaagaaatgggtcacctgcttcttttttttttttttttttttttccagagctggtttctgttgctccttaggaaagaatcctggttaaaggtgaataaggaaggggtatactgaggcatgaatatactaaggcatatctaccctccctgcccatcatggctggaaacttagtttttaaggtttctctgggtactccttggccaataggggattctgttcattcagtcaagggacttgagattttatttttagttatctattctttatttgtttccatgagtatcttcagaaccaacctctggactcctcatgatttggggaaatgcactattcatcattgtatcttcaccatctagcacggtgctaatcatatagaaggcattagtgaacacttattgaattaacaattgtaagtttaatgacttgaaactttgagccacaggagaaatctgtagataaacacagatttcttagtaagaggaaaattattccatccttacaaagacagaaatctcagcagatcagatgaaaataccatagattatcataatgagggcacttgcccaactcttgaagggaaatatgtttttagaaacccttattaaatactacaatatcagaaggctaaatttaaattaaaaaaatgtgattccaaaacaatctgagcacaacggggtgaccacagtcaacaatatttcattgtacatttagaaataactaaaaaaaatactaggattgtttgtaacacaaagaaatggtaaatgcttgaggtgaaggatactccatttaccctgatgtgattattacacatcatatgcctgtatcaaaatatttcatatactcaataaatatatacacctactatgtacccataaaaattaaaaatataaaagtaaaaatcggatccatcttttccctaaatagtggttgttcaaagagacatttaaggcacaagtgttgtttgtgcagtattgttttgcacatatcaaattctaggttttatgtcttacccaccctggatagaaatttatatccattccaggaggcggaggttgcagtgagccgagattgcaacactgcactccagcctgcgtgacagagcgagactctgcctcaaaaaaaaaaaaaaaaaaaaagaaaaagaaaaagaaaaatttgcacccattcctgtattctttttataggcttctgtaagcttcaaaaatgatccttaaagagattgaagatgatgactcagagcagaaaaataaaacaaaaacaacatgggtggcagagttgcgtgatagaaagaatggaaccttcaggtccagttaaacctgctctgctattaattagtttttggttttgaggtgatttttccaagccgtcattattagtaataagagctacaatatcattggatgaagaagaaaaatttctgaacagaagcatagctcccaaccatatgttttccataccagcatctatacaggcaccaaaaatcatggatgttcttatagccttgtgcctcacggcgtgaattgctcattgatcatttgaactcgtaacaatggaaacatcagttttaccaggcctcctgggcacttgtctgacctttctgatttgtcaaatggaattgcttcgtttgtaaaatgtttcataggagacaggacaacaatctctgtttgatgaaggtgaatgtacccaagataatttctagggttttaatggaagagttttgtgacagctggtttagcatctcatgtaaaataaattcaaggccttttgtctcactgaaagtaaggtcacattattaagagagaagatcctcctctaccaaagtcacagggattgactattcagttgaaccccagaggggctaatctgtccctgataaagttgagttggatgagtatcatgcattgcatgtgtttgcccatgatgagatatatgcagaagaaacaagaacaataatataggccaatatttaatgaggacttaccttgtaccagataatgttttcaattgtcacatgtattagatcctttaattctcacaaggatgatatggaggatacaggaccatttacattatttgtgtgatctagtgccaaataaaaatgtaagctccttgttctaaaggcagaatgaaagctttttcctttctttctcaattttttagttaacctgtcaaacatagggatactcagggagcaactgtagacccccacaggcactcacgaccccaccccacgattctttgtgtggaggcagaaggttgcagcagttgctagagggaggcagaaaagtgaatgaggaagaatctgcctgggtaggcaagaacattcaagccaaggctccaagtccctggctcatgttccattgtgccattgaacttgaaaaaacatgcacacgcataaattcacagataaaattcttaagcatttcaggacagtgactagaaagcattaagccccaaactcattgggttctaagtgactgcactggttgcatacctttgaatatggttctaaaagtaggtaataatattatctgaattttacagataaagaaactacaattaccagaaacaaagtttttgtgtttgtttgttttggtgatgtgtttgtctaccatataatcacgaaaacatactatgcctattatacaaaatttagcttgttctatattttggtatacttttaatactactgttttaaaattcttaatttctcctgcatgtcttccctcatggctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaaaaaaaaaaaaatacaaaagaacattccagaaataattacctattcaccatctttagtacaatgctgtacaaataattaatttttggttcgttattctctattcactttttcctaacatatggacgcatatatatgggtccagtgaatcccattcaaagagaatagatggtgggaaaactattggatgccatcagaatattttaaagaaaaaactgtcctttgaaacaaattctgcagaatattttgaacggaataagagaaaattggtttcaagttaatcagtgaaagtgaaacacttgctgaggccataataactgccattcctaagggctgacaggtcatgccattttccaatgtcttgctgaaaaaaataatttgtgtaggctaccactgagtagccatactggcttgccttgttcctgccttccttctgatttggggcactgcagtgggagctgacatgctgagctactcagctgtctcagcctcatggccaggcctcactcaaaacagtgtccgaggaaaatgacaacatccctttggggaactgagctagacctcatatagtatttgcattcatggaacagcgttttcttgtacttacagaacactttgttctatttaacagcatacatagttgtatctgattttattgccattgcctttgaaggcacacattcattgtgctatggtttggtaatgttcttctattcaaattgatttgtaacaaagaatgggtttacttggactctctgcatctagtgttggttcatgtcgcaattacctgcaggcagcaactgtttattgatgaggattttaccatagttttatgtgattacatgttagtttagctttcccttctaaatcaccacttagtttatagttcaatattatcgatccaagtgctaccagagagcaattctattgatggcatgttacgtgtttggaaggcagtctaactttcaacccacactctcttttggagagaatgttgcttcaactaacaatattgaggctcttgcttaaatattcatctcacacattagagtaattggcattaaataaacttcatatctgaatattttcattaagaactggagagttggtggtccactctaaagtgtccatatagaagttggctaactttttctgtagatggccagatagtaaatatttagatttaaaagccatatagccctgtcacaactactccattgtgctcttgtagcacaaaacagccatagacaatgtctaaacttattggtaaggctgagttccaatacaactttatttactaaaacaagtggtaggacagattttgcccaatggccatagtttgctaatccctgttctaggaccctaagagaggtacatttgtagaaattatgtttggaaagcagactagctacccagaattccaaacaataggcacatggaagtttggaaaactcttcatttaaagcattttttagttctagatgctggtaatgcaatgctgaacaagaccaacatggtttctctccttataagatttgcattaacatttgtgaatgcataaagacttaagtgagttcaagtaatgccaaatgcaataaataaaattaaacagagtaaagtaaatgcctggatgtgggaggaagtataactttagataaaactgccctggaagcttttctgagaaaatgatatttgaattttggacatttgatacttgaatgatgagaaggatctagtcttggaagggtttgggaaagagcattctgtgcagagacattgacaaaggtgaagggcttatggaagatacatacttggtgtgtttgaggaataggaagacaccagtacggttgagaagggaaagggactgttatctctatcttgaactgtccccattaaactgatctataatcagaattttaagtgagttaaattctctttctgatttacaatcatcctttcttttgttcttagtcacttgtggaggcaaattcgcaggttatctgcagcctttcatgtcaaaatgtaaatgtttataaattccaactcaccattattaaactggaagcaagccagtgtttcagttgagggacagttaaatcacactgtttgaaccatatttgaagaaatgatgacaccagtgtattagtggtaagacttgtggggttaaggatccataggtctagtcatttgagctatagagaggatttcaccatagtcaatggtcttcaattgctaaatcgggtaaaatagctcaactattagtttcactatggatgtctagaagcccaaaactcatcagttaattgaatactgtagactgggggaaaaaattattttatccaatcccaaaagaatcaactcaagtttattttacagaaaaatattgcatctagtcctatattgtaattttctgaaggtttttaaaataaaattattttaaatcctttgttgctaatggttgtaaaaacactaatccaaagagaattgccagtatctaaataaaacaccctgagttaatttgactcaaaaaatcaagtcctttgcctcagttaagtagaatgtgagaaaatggttctaacagaatcaagttcagctcagggaagttaattagagtgtcttgccttaaaagacaaggtagttttctaggcaatggtatttgataacaatgtttcacatgaatgcaacaaaattctgtgctctgttaagaattgccgaaagagaggaaaactctgtgagagagtaacctgttacagtttcagatagccagagggggaaatcagtctgaattcataaaatagtatatcatggattttttaaaaaataaaattgcttcgaaatacatacaataactcgcccaagatgtgtatgggtgcgtgtgtgtgttatctccatcccaataaatgctattgggaatatataaggctgacattatcattttagttgattaaaataaaatatctaagttactcgtagcatgcttaaaatatttttataagtaaggtaaataggcttgacaaactggtgatatcttaatttgcttctcatatccatttttatggatatgataaaggtacttgtcagcctagattttgttacaaattctcaatttatgtttgattctgaataaaattttattaaagatgtctaaatgcagcatctctgctaacataggatttccaaaattttaatttgtcaggaaaatgaagagtaagagattacattgtgtaacatagggcatttttttcctgcctcgtcttagcacaagatattacaggggtttttactctttttttaaattttaaatcaggattagtatactcatttttttcttggtgtttcctatttgtaactgatataatgccacaggcctgggagctttaaagaaaattatttaataataaaatagtatttaggagctcttttttttttcattttctgagaagatataatgcattcctttaagcattttgaatctcttctctagttggcagcagcaaatattgtaagggaatatttttgaaatatgaatcttaatcacatcttctgccatatccacaagagtttccattttatatgccacattcaacttcattcatctgacaacaatggaaaaatgttactttagacatcaatggaagttttactgagtatcatcaaatgcttagcaaatatttaaaatatttcacatattcttacgatcagaaattacacattgaagaatacttcttgatttgggaactttaataaaaagaagtgagaaatagatcttggtctgacatggaaggtggagcaagctgatgactttactaagtgacttgctacattcttatagaacaaggtagtgggagtatttttcactaaactatttatgggaccaaggtcacgtaacttactcttgtagcctaagctggtgataaggcttggacttttaatttccaaattatagcatgcaggtattagaaaactgatgacgcaagccacgattctcactgaaaaagaatagaacaatatcacacctgtaaccccagcactttgggaggtggatcacgaggtcaggagttcaagaccagcctggccaagatggtgaaaccccgtctctactaaaaatacaaaaattagccgggcgtggttgtaggcgcctgtaatcccagctacttgggatactgaggcagagaattgcttgaacccaggaggcggacgttgcagtgagccaagattgtgccactacactccagcctgggtgacagagggagactccatgtcaaaaaaaaaaaaaaaaaaaaaaaaaaacaacaacagaacaatagcactttcactcatttgcaattttagcagagttttcatgggtgaatatcaacatctgttgctccatttcctgaaaagtcctgtgggttggaatgccagtgctgtcccaattcactttgtcttttgctttagtaatagcaaaaatcaatgtaattaccatcactattcacagttttttttaataaatagtgggaccctcatttaagtcgataaaattgttctgtctcattctttgcctttgttcaggatcacatatgaaattcttttctgcaagatggttttctacctccattgaccttgaaatgaaaaattctttcaaaataaatattttacaaaattatttctaagtcgaaaaagacttagtgtcttggtgtacaagagtggggtaataccagcatgtttctcagtggggagtggggtaaaagaggaggacaaaaaggttaattaatgcataaaagtgcctagatcaaaggcaggcaccactgtaagcaaaagacatctccttgaatatttcctactaactttcaaaaacgaatggaactcagctgtggtttaaataataataatgcaagagacaaattcaagagctttgtctcttgaatcaaaaatggttgtcaagttttctggttgcatatacttaaacctgccaaaggtaatgatggctacttcaagaagtctgcctaagatgttgatacaatcaacgactctgtttagttgttcttgccaagaaagaaagaaataattccagattccaggtgttactacttagctggatgttttactttataaggaggcagcaattcatgagaaacagctgtaattacacagcattcaggtatttcataattaaactaacagctgattttaaggtggcacatggcatgagattttgcaactaggctaagtaagcatgaaagtgtagcttagttctcttgctgtcggctttggacaaatcctctctgtgccttggtgtacaagagtaggccaataccagcatgtttctcagtggggagtggggtaaaggaggaggacaagagggttaattaatgcataaaagtgcctagatcaaaggcaggcaccattgtaagcaaaagacatctccttgaatatttcctgctaactgtcaaaaacaaatggaactcagctgtggtttaaataataataatgccaaatactggaatcatagaaaactgagtattcttatcggtatccctgtgactcagtgattttggttccttagagaactcatcttgttatgtaggactgaagaggagcttggatgtcagttggataacattgatcctgttgaagctgtaccaggcactgtgtaaaatacaaaagttgtagagtcatctgcaggtctggtatacatggaatttacaatctaagtttcacgcataaaacatctttccggggaagacataagctattgcccttgaagatttgtaacctaggggttggagatagactccatgaggctgaggctcctctattccccatgcttcaggagagttgctcaagttagtcatggctgtgcctttgcttgtctctcccaagttctatttctattgcttggtaagtaaaacagcttattttcagggttctttaacaaattctgtaattagtactctaaagtgttcagtgatcctgactgtgttacttttcactattgcttaagatctcatgtcttttgagtgacctcttccttcaggaacccttagagccttggttttgtgagcccataaatgccaggaagcctccaagatttctagctttgtgaagtttacagaccattcatttccgcagtctcctgttgtcatctctaggggaattgcagtgtgtccatccacccttgaggcatggcaaggtgaacatcccttggactgaagactgaatgcttggttttgttcccatacttaatctgagagattcaaataattctttactttgctgctttcctaagactattttaataagaaaagcatcaaaagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgtttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggtcatgccaattgaaggtgggaacacagtaggtgggtttgcaggacagaaagaatgtatgtatggctggtgagtgaacaagggaggggtggtggtgggaaaagatgcaaggatcaggcagggtcttgctggccaaggtaaggagtttgcatcttattctaggagcgacaggaagcttgaggaaacatttataaataaatgagtgatgtgattccgttatgtattgcaaagtttcctccggcagctgagaggttgaataatttgttcaaggtgaggtgggcacaaagaagaaagatggagggggataaatgactcacttggcacctgggtccctctgccttgaaatccctttcctgaatactggtctattttacttgactactagtattaagagattggaaagaaagaatgcaagtaatggtcagagaggcaaaccgacttaaaaagctgaagcaaaaagttgcattattttaggaaaatgaagcaggttcattcgtgctaactcctgggaagctggcctttgagtggctggcttgcgtggcccttgcagtgttacctggcaactaaggtaaccaggtgaggaggctcctttttaaacataccactgagaacaaagcttcgtttttggatactcaggtacaaggaggactgatatgtttgggtctcctgaactgtgttcctgaatttcctctgccttcttgctaataacctgaattgtgcagatactgctgcggctaccagcacacaccagtgttgaaagcagcaagctttggaaggttaaggagcaagttgtgcatgaaacacttgaccctgccctgctaaataaagaaccgacatacagcctacagtgggaagaaaagagagagaggatgctccttgagaatttttttttgtgttgcagactcttcccctccccttcctcctcccaacccacccccagtccatctgtgatgcctgaattctttacaggctgtcttgctaaagacatcctagccttaatcaccttctctgtattgtgtatcactcctgtatctatctacttatgtcagttgtttaccagttcccttcagctgtctgctttttatcatattattgatcagtcagtcttgggcgtcttaggttggaggggagagagagagaaccggcaaagggaagcaggagtagagaatagcggtggcggacaatcagttaagatggttccaaaaatagctcagctctgctgatgacagctctgcttgcagccaccccgtatgggatttacgcacttcactaagattctctgctgaaacggattcgaccagctgctcctgcagttggtggtggctggtggcggcggtggcagcagtgggctggttacatcttcagagaaggaattggaagcgataggtttggggcaaggcaggctcccacacagggacatgagatttattatcagaggctattaggactcaggttgtggggcatctgtgttctttgtacactatgctctgggcacttggcatccagtttctttttgtccctatctcttttgaatgagatgagggagtaagtgatgagaaattgttatatttctcacccactgtgtctattttgttgctattgctctagtttattatatacataggctttttttccctactgcactttctgttgggagactcagctatgtacaggtcccaactttataattctttggtcttatccaagactttcatttgtcaaagaaactctgcaaagtggctgggtctaaaaatgtaatataagtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagcaaaaaaggaaagagaatgttacttattctattatctgccatgatggggaaaggggagacagaaaaacaactttctccttataaatcccagcttttgctgctgcctttactataaatattgttattcaaaaggttttcacctccttcttgggaggctattcagtgaagtataagatataaagagcaattttattgcctaaatgagaagctggccaaagtgtagtttcctcagctccatgctcagaacatctgattcagtaggttgagttgggactgatatacattttcataagcatgtgcagtaattctgatgtagctcgtctgtggaccacaactcaggaaccctagtcttttaaatgtatatttttttaataacatggtgctctaatttggagccctcagaaagaaaggaaaataaaacagcataacctgtgtcctccatgatagtttagtgggctctagtattagtttatttcatgacatgtaattgttattttcatttaatttgctgcacaattacttttatgtataatccatgttgagatgtgaataggacaatttactttatttaaatactttcagcattggcatacctgaggagataatagactatgagtagggaagacatgggctgatgttctacagtgttccagggtcagccattttcttgctgcaagccggagaagatccacacttccttctattctattgagccttagagtggccacaaggagtatcagttgctccctcctttgaaggctggagtctgtgaaggcagtgttcaagttcacttgttaacccacatcgccacctactgtccaccccccatccttaattaagaaacttttgcctgggagttgggcggagattagtgtgagaggctacagtatgaatgaaaagtgagattgtgaatgcacctctatcgagccctattcagaatgcttgatttgcaatagtttattaagaattacagcattactatccttaaatctaaagtctctctctctttcagtccagaagcaaattacttttgggttagaaatagcagccaagttcctgttaaaatgaaaacaaacctctctccaccttgtgtctaaggccctctttgttggctttaaaatgtttattgatttggggatttaatgttggatccaactgtgaatagtggccactttgggcctggtgagtgatcctggaatttgtcaaacaagtttatggaaggaaacctgaaaatgcttcaccctagtcctttgcctctttatttttgtgggttttttttttttctctttgagaatgttttctatttgagtggagaatgctctcatatggtacttttctctgatccttttggaaagagcaagtgtcctttgagaaatacttgttcttggttgttccctgctccccacccccatgcctgtccctgccacttctagagcaggtggaagtcgcctgtgggttcttctggtctcaggctttgactgttcccctccacaaatttgttcttaattcgattttgtattgaagcacatcagttatttgggcttccatctttagtgaaaagccacctttgcgtgttgttatgccacattacagtgttccagaaaacatattggtgtagatgcaaaatcttgccttcataatttttagccttatgttggattagagagcatattttcaagttgatctcttggaacctcagcatgaatctatattagaagcccagagaatgctaaacagagttttcactgagccatattagataacaaattattttacctataaatgagatattaattatatagattagatttttgttattagattatcagctatggagtgatcaccaaggaggataaaatagaaatagtataatcttctttgcccccctttaactctactatctgtggaatatactgaactttttacaaccaagtctttaatgctctttactttccctagcaaatgttcttccatttaaaaagtctttaaaatacttctttattttagcagtgcttcagaaaatctatcttagaccattctatgcttttaaatctatgataagattaattaagtaggctaacaacctcacttaaaaatattacctcgttcttgtaacattaatttctacagatttttttattgtgtagaagtagatacatagatattcctagtaactatagtataatataaaattaaaatcctatgtgttgaatcattatgttaataatagctgccatttctggagcactgtgtcttccaggcctctggtaaacactgttgcatacattatttgtcttagttctcaaaataatcttgagaggtttgtactattctttccatcttacagatgcagaagttgaggcacatgaagagaattcttaggatcctaaattttcataaatgccttcaggggaatttgacaatcaatctccattaggatcacattctagtagttttggccaaggagagtaaaggaaaagcttgtctttcttgcctagaagtttaaaggtcaaatcctctctctagccatattgcaattctggggacagttcctattgattgggcacttccatctaatatgctgttcaactgagattctttctggccaagagctgtgcaggggtaggtggcctcagagaaggagctgctggaagggagaaaaaggtggctttgtccaaaagagatgaagctcataggcatgctgtgcttcataccctctactagccttgctcatttaggttatttgctgaaaactatgcctgtctcagggagaatagtgggtgctggagatccgttggtgagtggatgctttctcttccctcatatagcttaattgttagtgctagagacagatactaaaataaatgtactggtgcaaagttaacaacttgacttcataagagccataaggggaaattttaaattgtgtgaaaatatatgactagaagagctgctctattctgggatggccatggagcatcacgaaaggctttgctgagcacatttgtgctggacttagaatgatggctaggagttactaggctaagaaagagggatgtgccaaagatctttaaggaacttaacatgaatgtggctgaggaaaagtgagggatgagcttagagagtgtggaaagggtcagataatggaggacacagtcagtcgtgataaggattttgcttttttatcttaaaagcaatggagctcatgtactttcctcttgatctgcccaagtacttcagtcttcttttccccttttatgcttttcatctgtccaagctcttcagctgagctttcctcactgatgacagcactatctggagtgaaggaggtgcagatcctgagatggactgcacaccccttggggctggatggacagactactcttcgagtgagataagggatgcaagtgtaaagggcgagtatgttgcctcactcaatcacatgttcaccaccctctctgccaacctttctgcctcctgctacaccctgcctaagccatgctgaccaaccttgtcactctggcctcactggagcaagaaagtcttagaatgctggagggttccacaagaataaaaagagcccaccacatctgcatgcataaacactacacagctagctcttgcttatttctgagtccagcaaatattatttgagtgtttttacacatcactgatccaataaggaaaacttgtataaagactaatgtttttatgcttcctttatagaacatgaacacatttgaggttttgttacttattctggagcattaatgcaagatccaagaatatcagctttaagatttgtttttctattctcagaataggtttgaaacagagagcaaaatacctacctgtatgccttctttagtgacagttgtttctaaaatatctgtctttcttctgagagaactatttgagtagtgagaattaagtaggaatggacataaagagattatcatgaagatggttttatgatcatcactgtcattgccattgtcaaagaggcatttattaaatgccagatttgattttagcattgttttaagttctgttacctgaagagaattcaaaatcacagtctttgtcctatgggaatttcaatctatcaggcagccttgatttagaaacatttgaagaggacataaaggtaacaagaatgaaaagagattggatcaatatataaaaactgaaagcatttatattacttagaagttaaaagtcaaaacaaatctagaatactgttgggatagtcagaataggttaggctgtgttgtggtaacaagccaaccccatacctcaggagctagcagaatggagtttatttctcacttcatacttcatgctcatcacaggttggcaagagtatgctttgtgtcatcattgttaagggacctagactgagggagcctttactatccagaatgttgctcgtcaccctggaagcaggaaggaaatcaggtgaattctgactggctttgaaaggtttctatccagaagtgacactttactttcacattcgctccattagcccaggcaagccacacggtaatgcatcactcgaagagaattagtaaaacagtaaagaaacacttctgatcaaatttagtaattattctagccacagtaatcagtcaatctaattagatgataatactattagtacttatcagcaacaaaacatgtgctaggtatcaaatgctttgttaagcaattcacacacattactacatttaatctttactgacttatgaggtgggttctatcattatctctattttccacatgatgaaattaaaactgggagtctttaagcaacatgcctcaggccacacagctggtattttgtagagctacaattaaaacccacttactcctaatttaagagtctgagtgttttttcaagattcctatcatgtcacagaagtccactgacttgttttgatcgagctgagaagaacagactagagtcacttctgacctggccacttagaattattaagaagtgtctctgctttgctagaaatctgtctttggctttgttggtatttagaaccagatggatgatgatgatgattattattattattgtaaaccgtcttccacttgttttctatttcctttctttaagggtgttagtgaataattctttctttcacccgggttcctggagctccttaagaattaacttcccaggctctttcatgtttttctggcaccatcttggatgatgagggcttagaacattttgtgactatgcccactgtctggaaaggcttgtaggtgaaggattctttaagaaaactcagatacttttctcaaattcacttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaattagtaaagtggtggattcagaattctagttgtttttcagctcctctgccttgattacctctcaccaagattttaacgaagagtgctatgttaacaactgagccacttactttctccattattatataattttaataagtttggtagcatgttttctcacctgtaaaatgagaataatgatagcacccatctttcagggttagaatgaggatttgataatttcatgctgcaaagtacttacgatactgcctgacacacagaaagtactaccataacagcaacaacctctttatcctttgccttgggaatcaaatattttctacagatttcacttttcaggttttctttgtacactgaattgtacctaaaatttcttgtgcctcctataagagttcatcccgaggagattggttgcattattaccatatatttagatatttatttcctttaatctggtcatttattatcaggcaaaattcacccccaatatttcacataggttcttttctattttcccgaagtgttggcaggtctgagaaataaagggaaagagtacaaaagagagaaattttaaagctgggtgtccgggggagacatcacatatcggcaggttccgtgatgcccccaagccacaaaaccagcaagtttttattagtgatttccaaaaggggagggagtgtacgaatagggtgtgggtcacagagatcacatgcttcacaaggtaataagatatcacaaggtaaatggaggcagggcgagatcacaggaccacaggactggggcaaaattaaaattgctaatgaagtttcaggcacgcattgtcattgataacatcttatcaggagacagggtttgagagcagacaaccagtctgactaaaatttattaggtgggaatttcctcatcctaataagcctgggagcaccacaggagattggggcttatttcatcccacagctgtgaccataaaagacagccgcccccaaagtgaccatttcagaggcctaccctcagggatgcattctctttctcagggatgttgcttgctgagaaaaacaattcagagatacttctcccacttgcttttgaaagaagagaaatgtggctctgttttgcctggctcactggcagtcagagtttaaggttatctctcttgttccctgaacattgctgttatcctgttcttttttcaaggtgcccagatttcatattgttcaaacacacatgctctacaaacaatttgtgcagttagtgcaatcatcacagggtcctgaggcgacatacatcctcctcagcttatgaagatgatgggaataagagattaaagtaaagacaagcataggaaatcacaagggtattgattggggaagtgataagcgtccatgaaatcttcacaatttatgttcagagattgcagtaaagacaagtgtaagaaattataaaagtattaatttggggaactaataaatgtccatgaaatcttcacaatccacattcttctgccatggcttcagctggtccctccattcggggtccctgccttcctgcaacaatttatcatctgtttgggttattgtcccagggaatcatattttggtaagacacgtattctttttagcttaaatacttgttattataatacaataggcttaatgactttggctccatgtatagcaatgttttcatttgttgatttgttcttttattcaacacatatttattgagaaaaagaaaaataattacagagactcttagagctagaaagaatcttaaaatcttttaggcgaaattcaccctcacttgtacagacgtaatactaagcatgcaaaaagatcagtggcagaatttgcttcttcagtgtcaaagtagattcaatgagagcagcaaaggaaggaacatttcacttcttttcatcttttccttgggtaattccatttccctcaataaagaagggaggttcttccatgaaattaggagtttctgctcctgtaggtttgctttagtattagttgaaacattttgaatcaaatatgaagaacagtaattcatatataggctgaaggacctagattttaagttgttatggctggccccaagtctgcattgacataaggaatgtctagagtacattctcaggtctgcagccttgcattctgatgtcaagaagcttgaatggtgtcacagaaagggtgtctgaagacatggtgcatctgtttcctgtggcttccaagcaaattaccaccaacctggtggcttacaaaaatacaaactctcttgcagttctggagcctggaggtctaaaatcaaggcactggcaaagttttagtccctccagaggctctcacggtgactccattccttgtctcttccagtttcaggtggtgctcagcactctttggcttgttgctgcttcactccaaactctgcttccatcctcacatggtgtttgctgtgggtctctgcttctctctccgtctaacttataaggatacatgtgattgcatttagaacatgcgtggctaacccaggataagcaccttctctccagatgcttaatttaatcatgccttttgtcatataaggtaatagtcactcttttgccatatgagataacatttatccattctggagattcacaggttctggggattaagacagggactcatcttttccaggggctgccattcaactcactagacctgaatttaagttcttgttctttgactgcctttccatgattgggcaagttactgcatctctccaaaactagggtttctgctctgtaaaatgagaataataacgcctaatttacagggttataataagaaataaaagtggtaaatatatgtatttatatatatgtaaagttacctaacccagttcttagcataattagttgctgtagttccaggcattcaatagatagaacagattttaaactactttaaagactagtgtgaggctggcctatacttagttaagaatttgttaaagtttgatgatttggttgaaaaaatattctggagtgtgatggttaatccctctggagaaccctgactaatatactgagtaactacaaaatgattttatatttagttcaccattatacatagaatagccacaaaatggttttatattcagataaccattatttgttggccatgcctcatttaataatatttcctctgtctgctttccactgcttcataaccactagcacattttgaaacatattactatgtgatgtcaaattctttaaataataatgagttttagtttgagtaacaaaccagtgatgtctgtgatgtcacaggcctgaaaaaaaaactgttgcaatgatcttcattggctaaattaaaatataaagagtagtatagaatttatcatccacattttacagaattattgtttgagtcatttagggtttctattccagtctcttaattgaactgtactttctatatctgcaagtcaaaacactcatcaaaaaatatgacttcaaatatgatagccaacttttgtgttactacatagtgttaattttacagttttttatatgaaataactctctgagttaggagacaagtaaagaaatgttgccaacactcatagatatgaataacaacgtaatttaaggcatgttgcaaaacataaacttttaatatatccctctataaattcttacttttagtattcttaattctcagatattactccttttcatatgattgcatttatattcttgtttaattctctcttttttctacttatatgatttcctccccactgacttctgctcctccttcctgcttatagaaagaatgttgacctcaaatgtctattattttttcattcaatgaactacagtaaagttgatgtgtaggtgacaattagtgtaggcaaaaggtagagtaatgttgctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcctatctgctcatcattttcattcttttacaacactcccactttcaaatcacatccaaaatggcaaaaagaacccaaagctaacatgattttagatgtcaattgtgtcctctctgtgaatgttttccatatttgaaatggctgtggaattatcttgcctctacccacagtaattgagaatgacaggaattggaaaagggtcatttcctctgtctcctgggattctgaaagctgtgttttcttttatacctgatcaggtctgccagttgcaaagctatacaatgtagtggagaactgcatacggttaattatgacaattacaatcagttctttacaatctctgctgctgttatgggatttaaataccataatgtatgtcaaaaggacaaaataatgttcctatgttttctgcttacagctgcttttatgattgggttttgctcataaacaggtggttataaagttgcaatccttccatgaattcctttatctttcctgtctcctaacctggcttccctggtgtgtcattgaacacaagtgttgagattcctagcatctctgaggtgatctcagatcctagacagtgtcccttgaatatgctgcaataaaaatgaaaccacttatggtcagcagaagtaggtagatgaatttagttaattctcaaagtctcccttgctacttcagacctctgtggtttgccttcccactgcgtcctgcaccttctctctattttctacctttgcttaatccctactttttcaattttatctcagtgaaacactgtgcctagtttcttctcaccattttggtctccagctcatagcatgttgtgaagactattgcatgcggacttgaatttatgtgctgttgatacttgggtacttgtctctgatgttacaagttaatccatacagtgcacatgtggtccctcactgttgctcaaggcagctggaaaataggtaaggtaatctttttctttcagcacaccttccgtctctgcagctcttacctctacctgaaaggtaggtataaagagaattatggccaatgaaactccatatgagagccctcccctcctccccagagtatatcttgcttaaacaacacatttacggttaatgaccatctggtaaaggtgacagcctttagtcctcctaattcttaactgtctgaaaaaatgtgcccaacctgccacggcttgtgactgaattataaaccatgaagcataataaagtcattaagtttcaacatgtcaaaatggactcaaattgcatcttgcccagaatttgatggcctttccccagcacttaagagagcagggctgtgtactgttcaaaaagcactttgtcatttctcgaagtactcttagctttgtgtggctgtctggacacaagcatcagcatctccaggagaaggaggaaatcgagtgaagtgagagcatggaggggccagtatgccacttcctagggaaaggcaaaggcatttcttctcaggaaaagagcagagaatgatgctgtacctcatttggttattgctcaccctcctgaatatatgattcattttacagtgggaaaattttggataaaagcttgtgctttacaattccgattacccttccccttttatcccccactatcaaaaataatcatattctataaacgtcagtggaaagtggtgagagtgcaactacgttttggagaaccaggtgtcagctctgtcagatttctatgaataggcacatctatatacactttttcaaagaaagaaaggtcactcgccaccctacttgtaaaactgtcagaggatttaggaaagaactaagttaggctgtcttttcacatgggaaaggaaatctggttctcaagatatttggggcattgcagtgaataagggatattaatagaattccacccccggcctctggctaagaacttatctgcctagaatctgaggaggaaaggaatctaagagttacccaaggctcagtctcactgcaataggaggggataacactgaacatggtggggcagatgtgggctttggtatctgttgctagtttatcctcccttcacccaccagcgcagtactgccatttcttctttcccctggaattctctatgtttagtgagcgagtttaagaatggaggatgctcagggatcttcttctcttatatagagactgggataatttgagtgttccatgttctgacacaggtggcatggatgaaggggtgtcactgaagaagctttggcaaaagctgatttacctttccaaaggctctgtgtcaggtgctggataaccgttaaaagaaaggaaagcaagccctctggcggctggcatgcagaaatgcacctgctaagccaatgagccattacaggccgtgccttcagattagagaaggacatgtcaaattagttggagagttttagaatactttatttattccagcttgtacatgaagttatcgatgcatctgctactccaagcatgttcagatgaaataatagaagaaagtctttaaggtattaaggttcatcttctgaaattgttcaacacttcttaaactgcagcaggcccagttgggcactgatagcaacttaagttgtcattactttgtgggattcagatctcgagaatatttatttagtgagagggagccagcaatttgtttctgtaggcaaaaggagattacagaagagagaccccctttgttgctgaattgagtagctgggaggagttgctggaagtgatgaatttaccccaagccatgaaggatgggtaagattagaacagataaaggaaatgaaagtgaacgtttgaaatataggggccacgggagcaggagtgggtttgtttttgaagtcagtagcaagcaagagttgagagtcagtggtaagtaattatgcacagagaaaacttggcaaatagataagaaaaaatcacattaatatttaaagtggtttaatatcaattgaatcacaaggacatcttaggtattcattatgaagctagagacagtatagcctctggacttaaggagtgggtctgtattcaaatcgtagttctgacacttctgagagtcctcaggcaagttagttagcttctctttgaccatttttcccaatctgttcacttgggatgagaagataatgtatctttagactcagatacacaaacattatctaaatccaggatgtagaagttgagtgcaaggaaagtctcagttgtccccaggctgcatatcattcaactggtgagtttccagctgctggtgtgcacaaacagaagctgaaggaccaatggcaggagaattacaaggcaagtttatgaatcagatggatatttggaccagatgacacccaggggccctccaacctagaggtctggtagttctaaaaattccatgatgtcccacaagagctaactgagatgtggggataataatgacataagtttacatcttacgctaaaaatgttgtttaaatttagttcaaaatgttctgttctatgtgaaaaaaatactatcattttatttaatgcaacctatcactgaaatgactatctcaagctgtttctctctatctcgtggagggaaggagtggaattgggggtagggtgcagggtggaaagaaaggagaggtaatactgttacccagagccaacatgttgctcttcaaaggggcttcagaaaatagaacaaagattccagcctgaatgagaaaggaggtggagagtttgaggaacacaaagctttaagtggaatttaccccatctaattatttgcgaaggaaagggtggaaagaaatgttgacagcaaagatttcatggagaacaggaacaataagaccctgtgccagagcactgtattctttgatgtaccacatatggagaagggatatagaacttgagttcagcaaggtttaaaaggcaaaatgtaatcacttccctttaattaactcaaacaatgcacggcaggttatgttaatgtgcctgtagctgagatagaggcagtaggctgccactaatacctgagagagagacagagagagagagaggaagagggagagaaagagaaagagaaagagagaggctcctgtaatgccagagcaggaagggcctagaaaccttatagactaattttacagatgcgagaacaagcctagcaaaattacagaactcacccaaggttatatggtctctcagtgacaaagtgaccataatacctcaggcctttaccaagttagtattctctctaagacactgcatgacggagtccatagtgatttcaagttagcccaggggttaaaactaaccatagtacatttgaatacggattaacatttggtgtgtcctttgaacaaaaggttaaatagaaaggtaaaatgtagaaaggtatctacacgtattcacttcagtcaagctttacttttaaagttgctttagaatattcttattaaaaccagtggtgattttcatgcagctgttttaattaaaatgttgtatgttttttataaacaaagtgatgaaaatttctggttatagccttgtagaagactgagcagggaaaccatcagaattgcaagtggagcaaaaatgttataatttagatcatgtgaccgaaataccaccaccgctgggtagaatctgcttaaactgcagctttggatttttcaggggtaaacaaacctcttatgaaaaagaaagccatgcattaaaattataaaggcacatgaaatattacaggaaagaatgagaggaagtaaagaaaactaacattcttctgttttactgctttcagggaagagttttatgaacagtttccaaaagtgttcttaagcggttgtaggttttattttgctttacaatttgacagtattttaagattctgtatttattctctttttgagctgaattatgcaggactaaacagatatcttttgtaaaaccttttatttccctgacagttaggagaaatatgaagtaggaaattctttggtaattgttggaggttggtatagtgcagtagataatgtccctttactgaatttattatcaaaatacacaagtcagagggaaggagatcaaaatatagcttctatttggtgatatactggtaaatgtttaattttcttccttttagaagagaggagactgatttatagtgttgacatatttttacggtataaatactccctccctggtgaaattcaagatgccaatgggatgtcactgaacttgaaattgggcagaggttcatatatttggctcttgcaagccagtgcaaacagtcttgggacagcactgcctgagtgcatcactcgtaaaggctgtgttagagagtgtggcctagatctcatagattagcagacttgttttaatacatcacttcagaatcagtcaaccttcaaccacaggtcttttcttctttggatgcctgtaccggtaaaactttcagcaagaaggagcaaagcaaaaagtgtgcttaccacaggcaggctggcagccaggagagttagtcgtctcccagactctaccaatctgatgaattcacaatctgaatcaagctggggaggccaggcatgtcactcagatggaaggaaacaacgaaagtgagaaataaatgttaactcttagcagcatcagaattcagaatgattcttagaaaaatgttacagggtttgtgtcaacaagaaggtcagaggcagaactgtattttaaatatccaacattttggcatatagctattctagcaaaagcatctttgaggctgtcatgtggcaagaattgtggttatcagaaaaaaaaataggagtttttaggttacacttaaaatataaagaccttaatagacctttattttatagaaagatatggaagaataaatttatattcagttccttcaaattaaattattttttcaactgggtgtaactgaaataaatagggcagccatagtaattttacttaagcaacttcattgcctcagagagcagatgatgaactattttagtgaatatatgaaatgatatctggcaagagaaaaatacttgatcatctcacttccttctagttgatgttcaagagtccctgcatccagatttacagctctttgcttacacatccatcattgttaatatgccaataccctgacgaagcaagcctggtattggctgcatgagtcagtttttcctggtagagagtggtttattattcttgttgctgctgttgtagtattaacatctgacaatttgataattaacaatgattataaattagcttattactataatgacatgagtctaagtggacatttgatatagcttatttttgagtgtaaaaattctggttctaagtcaggtgtctggaagtgttttgttattatcaccgtgctagaagataaaatctgagttctgaatcaacctactttcttattctgttgcctgtgacattgaatctcatgttcatatgttcatgtgttttatgttcatatgtttttacatttgcttccctttgttagaatttctggttaggtgtgacccaaaactcttaagtcaggtggaggagcattttaggactggctctgccatttaacttaaataataagttattaagttattataacttaaataataagttaatgaatctttccaaatctgagctttctcatatataaaataagaatgctaatgcatctacctcctaggcaccagtaaagattaagtggaatcatgtatatagtgtgtaacacattttgtgtgtgtgtggttagtttctttttttttttttgagtttgttttaatttttagctttctcaaataagagaacatgtgaagtttgtctttctgtgcctggcttatttcacttaacataatgacccccagttccatccatattgatgcaaatgacagaatctcattcatttttatggctgaatagtactccattgtatacatgtatcatacggttttttttactattatactttaagttttagggtacacatgcacaacgtgcaggtttgttacatatgtatacatgtgccatgttggtgtgctgcacccattaactcatcatttacatgaggtatatctcctaatgctatccctcacctcttcccctaccccacaacaggccccggtgtgtgatgttccccttcctctgtccaagagttctcattgttcaattcctacctatgagtgagaacatgcggtgtttggttttttgtccttgtgatagtttactgagaatgatatcatacattctttattcattcatctgttgatggacacatagtttgcaggggtacatgtgcaggtttgttgcatagctaaatatgtgttatgggagtttgttgtcagattatttcatcacccaggtattaagcctagtacccattagttatacagtaatttcttaatacatattataacatttgttaattgtataagttaaaaattttattactataatatttgttaattttataaattttgtatgataaaatacgtgtattacattcaatgcatggctacaattagtccacgtttaaggactgactcactttctagaatttggcaatactatgtctctcaaagttttcctaatgaaataagctatttatctttccaacccacagctcttcaggttcacatctatttctttgctttctcactgccctgacttctacccttccctttttgtctccctagtacccaaagtcctcttccccactgcacctgccattcttctccaggtgaaagtctgatttaggaaaagtgtatgagaaactctcataataaagagtgcatttgtattcttaaagcattacagcagagctaaagcctaagagtataatttcaatattcaggctgtgggtaagagaggtatttgctcagccgtagattccttttgatgcctctgaaatcactgtcatatctgtaactatctattgtacagtccatatggcaacctttaattatacctgttggaataatccacttagccaaagtcaagcatcctctgattacgtgttctcttgttatttcctagttgtcatatatccttggcagctgtcatcagccgaatttggtgtttctaatttttagtagctgtcatcctgtcccaagtttctgtaacacatgcttcggccttgccaaacatgatttgctttaacagttagtcataattttttgggccttaccttggcgggctagtggtcacattttactgtaggtgatctttacaagtgacttcagctccctcttctagctttacctttttttttaattgcacaaaattctatgtagcatgtcaatcgataggcaaaaaaagatctgttagcctccattacccaagagtgggccatatttcagtggtaggtaaatttggtccaatagttatgtttgaaatgccaacaatgaataaattaaattaaaatttattgagcacctacagtgttatagttatttgcttgctaatttgattttaagtgtgtgtataagtatatgcatgtgtgtgagtgtgtataatagaggctattcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggagaatcacttgaacctgggaggccgaggttgcagtgatccgagatcacgctgctgcactccagcttggggacagagcgagactgcatctcaaaaaaaaaaaaacatacaaaaaaggtatatatgactatagccctttttcttcataaggtttatagtcttcaacgatagagtgacttttatgtttttctaccagaagattcgaagttttgtagagacaaatgtttatgacattattactttggtaaagttcagtaaagcaaacaaacaagatgaaaacctgcctgctgagggttggttaatctcttctgaaaaaggtacactttggtataatgattcataaaaagcatgtggacactttacagctttacatttagaataaaacctgtaatcccaatgcctgttctatgtgttatacctgtgttttcctgaattatatgtctgtgtacctcctctttatacagtgtttcatctaaaagggtggcatttactgctagaatttgagatcatgaaaaggaatgattttagcacaaaaaaaactaaacctgttttctatcaaattctaagaacccagaggcaatgaatgctactgtcaaaaataatttgaagaaagtgtatctgacagtatttttcaaatttagctacaattttggttttactttggggtattgctccagtggagattcgttcatgattgtataccttcctagaatatacagatttttcttattaggcattctaaggagagcttgttactgacattctgcagaactttacagtcatagtatttcatctgtaatattatcttatagaatataaagattttcctgtaaaaatggaagtgtccccaagcctgtgtttctagtcatgtttcaatcactaagtagctttctgacctggtcaagccactttaccatctttctgggtcttctttcctcattggtaccaagaaagggtcagagtatttgaaccttaatgtctcttcttagttccaccatgttgctatgcacaaccctcatccactgcttatgactgctgtgtaaaacactccaacctcagtatgcctacaggcattccacaggaggtctatgaagcttttcacagttgcaaagtcatttttcccctttggaaactggacttcaataccattttggttcaacatgtgttttcttacactgataacaagaatgggggctcctaaaagcatagatgttctttatgacatcaacctcgaaaatgtaaaggatatattcaaaatataactcctctaaagtaagtaaccatttatccaaaaatttagagggtatattcaaaatataactccccaaaaataagtaaccatttataaagtaactaatgtaaatacttctggattctaaaatgtatattgggttcttgggaacttgaaatagcaattattttataaatcctttgtaatagtcaatagcaaagtaagatcattgatgtgtgtttactccttgttgtctcttcttatacgtttttccagaggatgaagttcagtacagtaataaagtaaaattaaaaaaaagctaatgtatttgtagacttctaaagtcttcaaatatttattctgccctgttgagtgtcttatggataggtaatattatctttaaaggtgatgctcaactttcatgctgttttatttgtttttttcttgagacagagtctcagtcattctgttgcccaggccggagtgcaatggtgtgatcttggctttctgcaacctctgcctcccaggttcaagtgattctcctgccttggcctcccgagtagctgggattacaggcgtgtgtcacaatgccaagctaatttttgtatttttgtagaaacatggtttcaccatgttggccaggctggcctcaaactcctcacctcaagtaatctgcctgcctcagcctcccaaagtgctgggattacaggcacgagacaccacacctggcctgtgctgtactatttatttttttatcccatggttacatatgttatgcaatgaaaatgttttcatgctacacatcaagtataaaactcttcaggccagactcctatacagattaagatggcatatatgaattgttttttttttctttctcccaaaggcataggttaggcatatttactgtctttgccaggccttttctcactttttaagacatccgaatgtgtagatttccttccttttcaacatttacattggaagatgaacatatttagaatgagccaaaagaaaaaatgctgcataaagcagtgttgaaggaagttattctggcagtcttagggttgaaattcgcaatccattacaagcatggaagctgtagagccttggatgaggctctacaaggattgggatttgtagaaatttgatgcgtccaaactctgtaattaccttaaagaaatccaagctttctgcaattaaaaatgtgtaattaaaaagtcatccagtgtgtgtgtgtttgtgtgtgcgtgtaatttatatccataaatatgcatctactatgtgaaacatctcttaagggatatgaatgtatgctgaaataattcagctagtgtaaagagggaaggaaaaaataatttatattactgggggaaggcagtcagatgaatataaatggggaagcaccatccccagcagagataataggttgagaaggagctataaatagggaaaatctgggtgtgtatggaaaaagtgacttcaacatatgattaattagaggtggtggggaaaacaatcaaagaaatatcaatgtgtagtaagtaaaaaatgtggaagggtggtgggtagaggagcaaagtatagtggaggttactgaatgcacagaaaaataattaaactcttaggttatacccttatccaagattctgaattagtttcttctactcagcttttccggggatggttagggcttctacagataggaagtagaatgctgtgaaaagaaggtacacttacgaaggaaagtttctgaaaataaaccagaaaactaatttgctaggggagttccctagtggcagagagtttacaccatgtgttgccctttctctctgcacttccaggaattccatctgcagaaggtgagtgacaggccggtggtgctggtaaagtctgtgctgaggcagtaggagagctgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagctagatgttctaccttcactagagtaattttaattcattctcttctgaagaaagaggtaaagatgaaggttgtctagggaggaggaatctcaatatttttcttcattaggacagttataatgttgagaccaaaaagatgtaagtaaaggtaattaacaaagggcaatctacttcctttggagcttataaattcctcaactacttagaaatgctactctgtctcaccctgacatttgatctttgtacttcagataggatttgacgtacgtttaagttctcagtggactcaggtttccggaggacttttttgttaactgctgattgaacctttattctgctccacatgattcctttgccagcttgtttgaagtgtttgttcctggtggaaccacaacaaatatgtgagctcattttctttctattaggtaaggtctttagagtttgggatttcaagtattcagtgtttcatgccttcagtgttcttttagaaatctgtatgtattcctacatttttcacaggcagtaatccagagaatctgatatggtttggctgtatcccccacccaaatctcacctcaaattgtaatccctgttatccctatgtgtcaagggcaggaccaggtggaggtaattaaatcacaggggggcggtttcccccatgctgttctcatcatagtgagttctcacaaaatctgatggttttataagtgtctggcatttcccctgtttgcaatcactttattctgccaccccatgaataaggtgcctgcttctcttttgccttccaccatgattgtaagtttcctgaggcctccccagccttgaggaactatgagtcaattaaacctctctcctttgtaaattacccagtcttgggtactccttcatagcggtgtgagaatggaccaacactggatcaaatctggcttatgtaaatctggaataaagagtaataaaaccaaccagatgctaataatatgacgccacctcttttctcccatccaagatgtgattctctagattttccagtctgatgatgttgtggagctcgcagttgacctgtatcttcttgatataagttccatgtggttgagcttggcgtttataacagaacagcaaaaaatgggatccctttcatcagaattcccctctttgcccccacactttgtagcaattccctgtttgccactttcaactctttgttgatctaattattggtatgtctacccaagaaaatcttaagcttatttggggactgtggtcttgttatatatatcatctcccgagatactagaatagcttaagtacccaattattattcagtaagtgcctgtttactgttggactttcttgaaaattcatatagaataccttcattttcttcacactttggtctgtaaacagtgtggaagtagtgaagaagacacaaagtcactttagacatgtttattactctcacttttatcctctcccctccatcagtgaagactcctacttgccatctttcctctaaagatccttagtccctgagaagcaagagctactgaagattatatcctaataagtttctaaaactcaaaagttttggtaggaaagaacatgtaggcttaattcctttctctttgacagtttggcccaattggatgctcaggtgtaatatgctattattagccctgagatgaaaatttcagggccaaaattattagtaaaacacttaacatttattaaatttttacagagtatttaatgtgtaaatatttactgcactgggtaccttatatgcattgttacatttaattctcattataatgatttattagctattacataggtatttttactatcatccttatctatacggagagtgaggcttgatgggatcaagtaatttgccagtgtctactagctcttagatagtaaattcagcattcaagttcatgcttaaattctaccctctatgccctccatcttatataaaccttaactccaggaaaaacttacctgtcttgtactaactgtcatatatttggtaggagaggcaaggagacatttttctaatcacattctttcagtatgtgttgggataaatttcaggggttggaatttccatcaagtgcacatgtacacctcttagaattgtcactttaggttatgacaactaggatgcattttttaaataaaagaagtgtattttgtatatgtattatatactgtattcttacaataaagtgagctaaagaaaagaaaatgttattaagaaaatattaggaaatattaagaaaatgttattaagaaagagaaaatatatttactattattacctgaaagtggatcatcataaaggtcttcatcatcattgtcttcatgttgagcaggttgaggaggaggaagagagaagttagtcttgctgtctcaggcatggcagaggtggaagatatggaggaggtggaaggagaggcgaaggaggcagtatattcagtgtgagctttattgaaaaaaatacacatatgagtggacctacacagctcaaatgcatgttattcaggggtcgactgtaccttgataataacatcactgccattaccgtattctgagttggtggtataaatggcatttttctaggtgatcgttatatatgtgtatcatgtatattaccaggtatagtcctgtaatagttccacctttctgcataaaagtcttcacaaagctaaactgagagttatagtaactgtaattatggaaggtaatcacaacaggaaatatgttatatgaaatacaacttttacaagttgttttacagtttgtgttatatgaaataacaattataggctttgttattctgaacattaatttgcattagccaaacaggagattcattttaggaatatttgtatctgtctactctttctattatctatatataccaataaacattgacaaacatttaagcattagaatttttgtctcaattgaatgaagctttcaaagatgctttttcttttttcttggaatcctgttgaatttccttgaaaaataaataagagttcacaccttctcagagtttcctctgaggtgttttgatactgttaacatgagcatcaaagtaataccaactcttaaaacacacataattacttaactatcagtgtatttctaagaaccctgtcatatgcacccttcttattttatgctcatgttgtaaatagacatacatgatgctgtgctgtcatagagaaaccatccatgttcactgcttaaagaagtgagtgtgagtttgagtgtgagtctgtgatgtatgtttagtctgtaataacaattctattaattcaatactgttttaaacatgcactcacatcctgtcatcagtaaaaccaagtgtcagttatccacacaattaatcaagttctcactcaggctttctagtaattcaactagtttcccatttccttatttcttctaggtgacatagttgcttctccatctgtaaagccagtataggatattttaattatttagttagcaatgtttttattaggcactcttttaggcactgacgatattaaagtgaacaagacagataagtccctgtttccatgtgaactagagtttacattccagttgtactagtaaacaactaaaacctctacataaggcagtttaatattgaagaatgtcctgaggaatatgaatcagaacaatgtggtagtggtgtggtatacacatactatttacttagggagacctttctagttggtgacttgaacttacacatgaatgagaagtagctagtcacaagaatatctataacaagattgttataaatagcaaagatagatagatagatagatagataaatagatagatagatggaaaaagccctaaagtatgaatgagcttggcagatttgaaaaatagattgactagtagagagtggatatttgcgaagatttattactaatgatagatctttaaatatccacatagctttaagggagcagtaaatttagcttaaggttagtaaaatgttcagtaccagcaggatatccctataagattttttaggattacagaacttggataaatggtaaattggatcaacatcatgccaattaaatttgttgtatggtctgttttattaaatctctaattcgtatttatataatgtataattataacttgctgcttatacagaatggttacccgtttagtattttatctgttcaacaaccatttactaatgtcctatcatatgcaagatagagtactaggggctgagtatacaaaaataaataagaccactctgtcatgaaaacatgtacaaaaaagtagataacacaggatttaaatatatttagtgggaaatatgttttctcagtttaaacatataaaaattataaagtggaatttcagatgagagtggcattgatagatataagtaggcatagctgatgcagagaatgttaaaatataattttgcaggtctgaaaaaccatttgacatttccttgtaattctggattaatgcttatatgattatctctgccacagtggaaaagtttataaatttaaattaatggaaattgctgttgatgaaaccctctagaggataatacatttctgatatgcctatagggctccgtatttaagctaaactcctgcccaagatgcaggatgatgaagtcctttatttcggccatcagacctattaaaaccacgagtatccctgtgagtccacaagtcaggctacaatacaacatcctcaatctgacaagaaaatcaactgatttactgaatttatatgaaccaattcttatatgcatgacagccaaaaaagttccaaaaagaaaacaaattttgcattagtatgagattttgaggttaggagcctacgtttagaggtttatcagttcagcccccgtatggagctatccagggtgctgaacgtgctctgcaactcagtccccttagtctctgggcttgacctattttttccattgttgtttcttatcttcaccttttattccctacccatactgcctgctctgattgctctttgtatgatctcatcaatcatatgtgacagatttttgtcccgacccttgctatgccctacattctaacctagtacattcttcaacccatgtttagccaaatttcaattaaaatttatacctacagccttcccaacaagtgccttgactctcaattttgtttcttgaagcaatgagatcattgatttgatctctaattataaagtaattaaaaacaattttatttcagtccacaaatacataaatattctaaaaaggagcctttaattcatttaataatccataaaaataaactgaaaaatcaagcgtggacttctttgtcactttcctctttttcattgtgaccttctctctcctcccacttctccttcctcctcatcatcattataaattcaatgagtcagaatggtttaattgaaattcttcatttaaaaagtaggatcttggtaaaatgtaggttcaaagacaattttacaatagtttaaccttagtagatgaaaaatagtaaaagtataaacaactcctgtgaacatattgtctttgaaattggtaaaataaataaaattgagatcacttcttactgtacatctccagcttattttaggatgtatctcttcctttctgactggaagactcaaaatacatttagagagttggagctggtgttgacagtcaatgattagggcaaaagttttgcatgtacttcacctctgtatttctccctaatttcatccattgtaatttaagaagaaggacatgcctgaattgaaaagttcaacaagtgaacttttgaataaacagtgtagatttttatcttaggtccaccaatccctaaccatgtaatcttgggtaaatctttaactctatggatctatattttttaaatttgcaaattgagaataataaaacatcctcacactgaagattcctgccagaattatatgagataatgcatatccaaagtttagggcagaaactgaaacctagccaacattttaaaaatgtgaattattgtcattaacttatcctttcggtgcttcacctctccatacattttaagatactctggtcattatgagtacttgccacaagtatataggagataaaagatttattttcccacccattattaggttcatagctgaggtatcctgtaataagagacagattaacaggaaaaaaagcatacaaattaatataatttttatgtgacattggagcctttgaagggaagacccaaagaaacagggaatcctgtgtattttagactttggtttcataaagagtggacagtcttggggaagtatggctggacaaaagtgggcatggcctgatggtaataagctgggggaaacttagcaaggcctattgttcagattcttcctggtgtctctgtgtgttcagctgctttcctctagttctagagagaatacctctgaatgaaggtctttatgatttgctttagatgaaagtcagaggattattttatggtctgcttcaggggagaagagtgagagaaagtcaaagagatctttctgcttctgctgctttctcaaatgccaagttgctgtattttggggtagtatgtcctgaaccccatcaggtacttgacatttcatgaaggtaagctgatcaatctttcatccatggcactcattaatgtctcaatttgaaatgttgtgagctatgaaaaaaagacaaggaaggtagtgcttatctactcatgaacaaccattattaactcactattaatcattgattacaattgatctattggccatggtattgttgtgaactttgaaatatattgtattaacatttctatgaaaatggtggttgaaattctgcaggcagataatgcagtgttaacataataagtaaaataattaatgatagtgaagttgtaaaagtaagaaggttcaatgtgcttgaaagtcacagaattttgaaaaatgcaagagataaggaaaactgatgaacaaaatgtgacaacttgagactggctatgcatactgaaatgaaccagtgacttttaaactagaattcttagagtgtacagcctacagaaatgtaaatatggctaatacaggtaactttctaatttaaatacctatcaaagcttctgttggaagaaaactagatttatacattgtgacatgctcaaaatccttgtcttctccaacaccatctccagtaaaatactcctagcataaaatttattaaagtgaatatctctgaaattaggttcttttggaattaaacaaaagagaccatggttttccaggcattgttgtagatgtcactttataataagacagataaggcagtcagtatacagaggtttggttttatggccagaactaacatttattcaatcaatgagagagatcaattagagcagcattacttctacagtgggaaaatttcagagcccctgaaatagaacattattgttaaattatcaaatatgttacagttgttgctagtataatgaccctttctctttatcagaatcagggaagaaaaaagccaaatggtgactaatttatcaccaggttcataactaagttaccaaaagactgaaactaatcaggtctgattttcaaaataagcaataacatttaaagcatatttgaatatacagatgtttggatcactgatatcctaagaattctatagtctctgctgattttaaagtcgagattagattgttcttgtatacccagagaagcatagctctaaagggaaggtgttctggggaaagaaaagaaaaaaatgacgttttcatcatcacactgaaaaagtgccaacaaatcctaagtaattttgtgttgattatactaaattagaatagtgatggctataatcatttgatccctgaggcattaatgaaaaatcagcattattttgtgtggaatatgtattattatccttgagcttaggaatgattattagtaagtctgattaaatctggaagcagtgacacaagctatctttaacccaccaatgacagggctatattgtaaatttatgatgaatgaacacagtttagcatttttagcacttgttggggaaaataagaagtctgcattcattttcttgattagactgcaaagtagtacagagaagctcataaaaaattcttcataatgaaatagtgttcctactgatagattaacctatcatagcttccaaaattcacaggactggttatccttgtatgatcaaagatattattcagcaacattctggagatcatgaattcctagatacagaagtataaacaataaaaatactaccatgttgcatgcatgtattaccttcatctttttttttttttttttttttgagatggagtcttgctttgttgcccaggctggagtacagtggcacggtctcggctcgttgtaacctccgcctcccaggttcaagcgattctcctgcttcagcctcccaagcagctgagactacaggcacacaccaccatgcccggctaattttttgtatttttagtagagatggggtttcaccatgttggccaggatggtctcgatctcttgaccttgtgatccacctgcctcagcctctcaaagtcctgggattacaggcgtgggccaccgcacctggcagtattacccttatatttttaaatgctttcacatttactttatggtattcttatcatagtaacttaagtgagttagactttttaccacctgctctatcagtaagaaaactgtagcacaatccagtggaggtatttgctaaaatcacacaggttgtcagaaataccagtattggaaccccagggtcttggtttcaagtctaatatattttctgggcctcagtttagccattaattttataattacagacaatgtttttgctaacatcttgaattctttctttttaaaaagatgtctattctgtattcatagaaaatattagagattcttactgatcaaatggatcacagcaattgtttaattttaattttcagtgctaggtaatggagctcagaacacactgactcaaaatttggcatttgaggaatcagcagaaggaggccgtagaaacttgaaaggaatctacttgccccttcttccctgaagcagtcatgaaagctaactgaattttcccagaaaataggtcataagactattatatcagaggcgttcttcctgtacctggaggaaaagaatgtccttatctctgaaaacatagggacactgaaaagaatctgaacaagtaggccttgccgtgttacccccagtttattaacattagattgtactcttttgtcctccaattatacttccatgcacgactgtccactctttatcaaacctaagcataaaaatacccagatttccctgtgtcttcgggccttcatttctgaaggctcctgtgtataagttttatataaataaatatatgcttctttatgaatgaatataaattttacttaatataaatttatgtaaatttaatatttttataattataaaattacaaaaatgattgtaattttaaatcatatataaatttattataaatttatatataaattttaatataaaatatacttaattttacttaatataaatttacttaatataaattattaagtaaatttgttttctcttataaatctgtctttattacaggagccttatccaggaaccttgtgatgtatgagtaatctttctcccctgtataggcaaaattgtttctaaaatccccatataatttagggcaagttctgatccttgcatagtagcatctgacactcagtagtaacttgattaaatattagttccttttttcctaattcccaccccaaatgctgtgaccctctctgcactcaaaagacaaaatctttaaaattcttagttgatctgaaatttgtgttgatggcctacattattttattgttaaaactatgattacaggtgactagtcagtaacaaaacataaaaattgtgaaagtacagccaaaccctgttttaaatgctagatggagttagtgttttgtttccatcaaagccacaatatttctacttgaaacataggccagggcagtggctcacgtctgtaatctcagcactttgggaggccgaggtgggtggatcacctgaggtcaggagtttgagaccagcctgaccaacatggagaaaccccatctctactaaaaatacaaaaaattagccaggcatgttggtgcatgcctgtaatcccagctactcaggagcctaaggcaggagaatcacttgaacctgggaggaggaggttgtggtgagccgagattgcaccattgcactccagccagggcaaaaaaagcgaaactccatctcaaaaaaataaaataaaataaaataaaataaaaaagaaacatagctttgcaactgaatggcatcccattcacttagcatcataatggaattctgttgaatagcttaaatttagggcaatcagagccaaagactcagttacggagtaactgtaggtcccgcttggcatgtgacagattagattccttggagaagttaaatccagaaatgagtcattttaataaagcaaaacacataatataaagggtatggataagaagctatgaaaatgcctaggatagacaaaaagaaagatatcctgggatagggaaagggacatttgaacatcaaattaagcaaagccatgaagtttggaatttttcttggcattttcttcccgtaccctgcaaatattaaatcaattgtcaatcaattgtcaattttacctttaaccatttctcttcttcatgtctttctccacacgatcactgatctagggtgagctcttactatctttacttataataggctagtttattcgctatttctatttccaggcatatcactctcaaaaccatcatccagattatttaaaaccttaaatctaatcacatctcccacttgcttgaaaccattcaaagtcttctagttgcctacaagataagatctaaacttatgtttctctgtggtctggcttctccttacctgtgccacctcctctcatgatgagccattctgtgatggtgcttcagcctgtaaaattgtttgtggtttcaaaaatattgcacttcatttcatgcctccataccttttcctcttcttgtaatgccttttcatattcatctccaacagggtaagttctgcacataattcagtgtcccttttccagtttgatgttgcagctcttccttcatctcaaatatccactggattaggtacatctgtgtgtacttcatcttatccatcctgttaaagaaaaaattatagaaggacaattgttaaagcatggtagggaaagttttatttaggaccatcatgataaatatatgggccactgcaatggaattgtttgcagtgtaggagagagaatgggctcaactctgtatatagcatgaacaagtgagaatttttaaccaaggaacagagtagaggtcagcagacagacaatgactaagaggtaacatcaggagtaatgggaattctggctaaactgacctaacagaattcttgctgaagacaaaccaatgtgatcaggtatcacctgggagttggtggagaatgaagaacttaatcaggtatcaagagtaatcagatatctaaagtggggcagttcttactaaactgacttagcacacttcttgctaaaaccagattttacaaggaagtgcacagatgagcctaggagaaggtagaggggtctgactaaagttttgatcaagtaaaaaagtctttatcaatcttggtatttcccgttaagcacaatgcttggaacataatagttgctcaacaaatgttggctgatctgattataagaataacatggatagatcatcctttgtaatctataagttttttaaaagtttatttttaattattatgaatacattccagttgtacatatttatggggtatatgtgatattttgatacaaacctgccatgtgtaatgatcaaatcagggtaattggggtatccatcacctcaagcatttatcattttttttgtgttaggaacattatacttctgctcttttagttattttgaaatatacaaataaattattgttaactgttattaccctgtaggtgttactgaacgctagatcttattccttctatctaactgtgttttcgtgccttttaacaatccccctttttatgttcccctcccccactacccatcccagtctctggtagccatcattctactctccatctccatgagttcaatattatttttagctcccacatattattgagagtatgcaatatttgtatttctgtgcctggcttacttcttaacataatgtgcttcattccattatttcttaacataatatgctttaattccatctacgttgttccaaatgacaggatttcagtttcttagtagctgaataatatttcattttgtatatgtactttattttctttatccattcatctactgatggattcttgggttgatttcatatcttgtctattgtaaatagtgctgtaataaacatgggagtgcagatatctctttgatatactgatttcctttcttttggatatatacccagaagtggcattactagatcatatggtagttctatttttagttttctgaggaatactccgtgctgttctctatagtggctgtactaatttattcccaccagcacactagagttcctctttttccgtatcctcatcagcattcattattgcctgtcttttggataaaagccattttaactggggtgagatgacgtcttatcgtagttttgatttgcatttctctgatgacaatctacaagttaatatgtctgaaaatctctcagtcatcctatcatgtttctactcttcaatgggaaaaattaatttatcaagccagattgtcatcttttcttaaaaaattacatgatatgaaattcacagctttcctattcaagtgagtttttcttatgtccagctagaatcccctttgggttaatataagtctttagtgtacgaatttgaatctttgcctgaggtgctacactgttggttctcttaaaaatttgtggcattatttaattcagtaaaatttgtgtggattgatttgtatcctttgaatagttagtattatataaatatctcagtctataagactcatccaaaactttggaattggaagtccaatctcctctccattagaagtcttgtcttggacatccagtctctatttaatccaatgatatgctccctgatttatctactcagactttttattgttagttaggtttattctttattttaaactgagatccgtcatcacaaaagccattcccatttacctgttgtcctttggctgtattgccctggttatatattactgggttttgctaaatgtttcctatcttttctttcaagttaaatctttatgtctctgttagattatcacatataaatgtgtaaaaacatagatattcctgcaaagcttacaaggaaacaataaaacagaaaagacttgatctaactcctccccacctcaatccagagctattactttcactcttttagttgtttcttctgattttacttccatatttccaaacaatgtggttatggtgctatttttattttgatgtctttacattcaatacatcaatgttgattttaggttttattttataaatatcctcaattttatcttccaattcttttgttgaataaatctttgctaataaatatgtatatacatatatttattatatatgtatatatatttacatataaataaatatatatacatattttaatatatatattttattttctaagggctttatgttgtattatttcttattttgatagcattcagattgcagtttttaaaagatacaaatcatttcttttatcatattaatgatgaggcttttaaaatcagttttctattctctgcattgtatctcttttttattccattttctttctttcttttctcctatgtaccttagtctcttgtttcatatttctattagagcctatcctacattgtctagttaatcttggctgtttgttgtcacttaataataaaactctaacaaaccattagaaactgtataattatagcaattttcaaaattattattagtgggtgaaattcactaaatctaaataggtggggatctacccattttattaagagaccaccctccaaaatgtcagatcttttctctcaagtcatttttttttagtaattcagtttctgaagtcttagttttctctctgtgcgttttctgcatttaggtggatagcatcttcataacagaggagaaaagggagtctgttaggcagattggtctcaggggtcagtatataaatttacacataatcctactatttttcttataacttcgcactgctgtcacagcctgagcctcttcaagtcagattccaatgctcttcttaaacagattctctgagtgtgtttgctgatttttgctgcagtggagagggtatttctcagttgatgtgatccttatataggcttttagtcactccatctgttttcagccccactgctggctctgccttcagaaatatgtgatgcctccaagttctctaactttatagggttctacagcaaaatatccttgtttactactggcttctttctctgtaaaaacttagctttccacttttttctgtcctactgtcaattaccacacatctatacacttttcatcttccaaatcttgttgacatttctcctctgctattgtcttttcatccagtctcttttgctactgcgaactatacagcctttatttttttcacaaccattttagtaggattttgaaagaaaatacagatagaaagcttgtgtttagtccaccatacttagtgagaagttgccataacatttttgaagattgaatgtacagtatggaatatgttcattatctcagtaccatgtttgggctcataaaaataaaaatagcagacatgagtgtggcctttattcatttgttcaacaggcttttactgcttgcctatcatgggaatggcaagaaacatcatttcagttaactgaaaggacaaatacaatattcttagtgatctccttccttcagttccccacaggaaatttgaggttgataaaacagcagcaaaagcatatttttagaagataaagagatggttcgtatgatgtacagaagtctacttgctactcaaagtgtgatcagtggtctagcagcatgcatccctgggagcttattggaagtacagattcttagtctcctctctgacctactggaacacaatctacgttttaatgaggtccccagggtagtcttaaaattggtccaagggaaaggattttattagaaaaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggttctcctgcctcagcctcgtgagtagctgggattacaggaatgcaccaccatgtccggctaatttttgtatttttagtagagataggatatcaccatgttggccaggctggtcttgaactcttgacctcaagtgatccacttgccttggactcccgaagttctgggattacaggcgtgagccactgtgcctggcatgaagtgattttcaaacatagttgatcataagaaccttgaaggggattatttgtttaaatgtagattcttctttcttttacattgtcgtaagtaatgtaatcaatgtggaatagggctgtaaacctattttaagggcttctgagatgctaatcagtcagatttgggaactatcagggaaaattttcaacccttttcatcatgatgtctcagggaccaaatatcttccatttgctacccaccacttcctgcaactcctaccagccatcactacagatgtatcatatcagatcctattttcttcatctttgccttctcctcaaatcatgtatagtcttgagactcatctgttcagttggcagagtgtcttccttctcccaagacaacatcctcgttttcatttttcccattcactctgtgccactgcttacctccatgcccaaatctccagctctctctttgctggcaggtgtcatgttctgacactgatttggggtcaagtctggggttctgaatcaggagcctgtgtttgatggggagtagatgccagaaggcattgacaagtggcaccatgcaggcgaataatgcaagaagagtcaccttgtgggaaaattgatgcctgataatctgtcccaccagggtgtcaagtccgagagtgagaatccatcaattaaactgtgggacggactttagagaggacagacttgagcacaggggtgtggagaattggttatggaagaaattcccaagcgaaatgaatatagttggaggaaatgtgaagagggtggggagtttcctgggcctctgctggaagagcagaatgtaagagttgagaatgttaaaccagcttgcataacgttttgctgaacagtttaattcagaagccaattgagatatctgttattcctgacaaactttaaaaggttctagaactggcaaaacaactaggtctgagcaaagtgaaaagacatagtgtgaccagctgggacaggaacgctgcaaacttgctaattagtctggaggaagccaattgcccacatttttatgtactgctaattactaaagtagcagcttgctataaagacaaaaataacagcatgatagtttcttgaatataggataaagtggcctttgggatgtaggctccatcaactttaaaaatattctgtagtttttaaacttaaagcatacagtgccgtaataaaaatacactttggaagtcagttattcacttttttccataggctgttagatgagaaattatagaatatatggtaccctgttgggaatttatactaaaggattttgttttaaagataccaactctccatttgaataccatttctcagctcattttaaacatttacccaattaaaaaagctaaataagtgattttaaaatgtgttttattttaaatacacagtgtttttttctgaaaatgctttctcaacccagttatatctgtgaaaagagaatgtcctttaggaatttaccaacttttcacgcagttgtagcattcattgtgggtgttcagtaaatatttgcagaaagaatgagtgaatgagcaaaggaataaatacacaaaaccttgtgtgcatgagaacgataggatttcacacttctaaggaacaactgagaacaactactccccttgtattcttttgaggatgaggaaatttaggcagaggacaagtaactcctctggggcctcacagctggttaggggcaaaactgggtctgggccccatttcttatgtctatcagcccagcagtcttttcattttaagcttatttgtattccctttaagagaataatgagttatttctgcagggctaattctgacctgaatcatattaaatcagcaaagcctggttttcttacactttcaaatgcagaatgacaaaagtaaagcatcttttaaaacaaaacaaagccaaagcaattggagtatttggttttattgaggagtgatgttttcaaaggcagagaagggagaaaaatggaaactctgtgccatggacttaacttgaaagctaaatgtcagacttgatgtaaaggaggaaaaccagccctgaggacctataactgcataaaagaaaaaaagcagatttctattgattgcagcaaatcaatagaagttcatgtatttgcggatttatttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgtcttcttaattaaaggtttggttacatgaccaaagagttgttaataatggtgcagtcacttatcaaatgtgtgatcccacctaacttatttataattctgaacctagtgtttctcatatgtacagataggttcctaatgacacttaccacatggggttgttgtgaggattaaataagagcatgcaagtaaggttttacatagtgcattccacataaaaagcactcaataaatgttagctattattactgttttcagtcactccaggcgagctatattgtaaaaaaccatacttccattgcttcttcactagagcctagcaaatcattgttttctactggtctactatttgtggatatttctaccccaagatcctttcccaagaggacaatgcaatatagttgaaagattcttcttcacttggtgttcagaatatttcattcaaattcaacattcacaagtgcaatttgtactcgatattgtagactttccagaaaggtgaggttcattcattcaattgcttcttggctgagcaaatttatattctcttaaatcttgataagtcagttaatcttctctaaaattgaggaagttatactcattccactggggtgctatgaggatcggatgaaggtatatagcaaaagtgcttatttgtaaacatcatgttgttgaatgaatattggttattgatattttctgaaggtccccattccatgcctttttcagggccccgtgtaaagccatcccttctctgaagctttccctgacttctctaccttccatctagatgtcaactctcctccttttcactctcactccatttcagttgatcttccttggaattcaaaatacatactgccttgtagagcagtgatttgtatttatttcattccttcttctacactttcagaaggaagtgtctacatctcattgacctcattgtcccacacagtgcataacacagtatcttgcctgtaataatgctcaacaaatatttgattaatgaatagacaggcttttatgaatccatgtgtaatgttaagttctatgaattatgtagaaatagtaaaagcaaataaagactcaattacaattttaactcttcaacaagatgatcaaatccttgaggattagaaattaattaaaaatgaactcatcctttattcattcatcccattatttaataaataaacataaatcgagcaccttccaggtgccagatactatgttggattcgaggaatttaatgcaattaaaataaatagtttcatcccatagaggttgcagtttgtaagtaataagaaataaggaaataattccaaacttgcttttgcaggatgaatatttagaactttctttattaaaagaggtcagtaaaacattcttaactgctttttctatccattattaattccaataatttggtcactgttcattagtgagattaaatttggctactgagagtaggtcatgcaaatcatctttctggttaaaaaaaggcctgtagctactgggtgaaatttgctttgaattatttttcataatcacaagtaattgggcatgtcgtactcagttataaataaatatacaaaagtacactgatctactttccttaataatgagtttgaaaaccatcgctatgttacttaaacttacttttcttcactatttaaaaagtccagagggcacaagtaaccttcagagaatctttccacattacaaggcaaaattatttaataaaatttctgaacatacattttaattgaaaagtcataagcaattctacactgatggggaaccagccaatgtgatgcaaaatgaatttctcagtaactgttttgtgtgtaggtaattttaagtgaaagaaattttttttctattgtacaaaccaagactaatttattcattgttgttccaaagcagcagaagccaccagaatgtcacattttatttttaattcacaaaattaaatatacttatggtgtacaatattgagttttgaaatatgtatacactagaatagtggactcaagctaacatatgtattacctcaaatactgatttttttgttgtgagaacaattaaactctctctttgcaattttcaagtataaaatacattgttattaactgtagtcattatattgtacaatggatttcttgaacttattgttccatctaactggaattttgtaccctttggtcaaacatctctctaatcccacccgcctacaccacctcagcacctggtaaccaccattctactctctcctgctatgagtttgttttttttttagatttcatatataagcgaggtcgtgcagtatttgtcttcctgagcatggcttattttacttaacataatatcctcaagatttgtccatgttgttacaaattaggagatttttatctttttaaaggctcaataatattggttgtgtacatataccatgttttctttttccatttccatttatgtgtcgatgaacacttaggttgattccgtatgtttagccaaggtgaataatgctgcagtgaatgttggactgcagatatctctttgtcattctgaattcttttcctttggatatataccctgtatcaggatcactggatcgtatggtaattctattttaattttttgaggaacttccatactatttttcataatggctacatgatatatccccaacagcagtataccagggttcccttttctctacatccttgctaatacttatcttttatctttatgataacaactaatctatagtaatagctaatctatagctaggtataaggtgatatttcgttgtggttttaatttgcatttccctgataattagtgatgttgaacattttttaatgtacttgttagccgtctgtatgtctccctgtaggaaatgtctatttagatcctttgcttattttttaattgggttatttgtttacttgctatgaagttgtttgaattctttatatattttagatattaaccccttatcatagaatgacgcattttaagacaaggaatgaatcttgtgaaagcttaattccctgtcctaattcctcaccctttacacctccttgcactagacacactcatttacaaactctatacttctactgtattcctatgactggagggtgtttatgagaaaagcaggtgagccttagagtaccagtatatcaatttttttccacagtaggttaagggattcatggagggaccccccctgccccccaaattgatttgccttttgcattagtcaaggttctggcaggaaaactggtgacactctcaaatgggggtaataatataagaattgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagaattgacccatttacaatagtataggcagggtaagtctgttgtcagggaagccaataaaggatggagaagcacctttttacccattacctctcttaggcttgaagggggaaagggagtgaatatttattggaacaaagagccagagatgtggctgtaactgggagagggcctcccaataggatctgaaaagttcagtagtgaaatgcaagcactgcaacccgaggcctggcagggaggagaccaaagaaactgatatcccaatctcacttttcccactccctggctttctgccaatgactcccatttgatgcagtccagaaagatgggcttcctagagagcagagtagggtggaaaatggattcagagggccatgaagagtatcagagtatcaagaatacctgttacattataaggaatatatatgtatatatgtatttattcatatggtacatgtgcttacaagcaggaagctattgtgtatatataagtgttatgtatttacgcatatggtacatgtgcctacaagcagaaagctattaatcctttcaagaacctttacaggcattattcatttaatattgataaaaccatttcaaatgagctgataatggtttggctgtgtccccacccaaatcacatcttgaattatagttcccataatccccatgtatcatgggagggacccagtgagaagtaattaaatcacgggggcaattacccttatgctgttctcatgatagtgagtgagttctcacaagatttgatggtttcataaggggattttcccccttttgcttggcatttctccttcctgctgtcatgtgaagaaggatgtgtttgcttccccttccaccatgattgtaagtttcctgaggcctccccagtcatgtgaaactgtaagtcagttaaacctcttgctttataaattacccagtcctgggtatttcttcatgtcaggctgagaatggactaatacagtaaattggcaccaggtagtgggatactgctgtaaagatgcctgaaaatgtagaagcacctttggaactgggtaacatacagaggatggaacagtttggagggctcagaagaagagaggaagatggggaaagtttggaacttcctggatacttgttgaatggctttgaccaaaatgctgatactgacatggacaatgaagtccaaactgaggtggtctcagatggagatgaggaacttgttgggaactggagtaaaggtgactcttgctatgctctaaaaaagagactggtggcattttgcccctgctctagagatctgtggaactttgaacttgagagagatgatttagggtatctagtagaagaaatttctaagcagcaaagtgttcaagacgtgacttgggtgctgtaaaaagcattcaattttatatattcacaaagatagaatttggaattggaaattgtttaaatgagaagcagagcataaaagtttggaaaatttgtagcttgctgatgtgccagaaaagaaaaacccattttctgaagagaaattcaagccagctgcagaaatttgcataagtaatgaaccaaatgttaatcaccatgataatggggaaaatgtctccagggcatgtcagagaccacaacagtccctcccatcacaaacctggaggcctaggagggaaaaatggtttcctgggccaggtccagggctcccctgctgtgtgcaacttgagtcccagctgctccagccatggctaaaatgtgccaaggtacagctcaggatattgtttcaaaaggtgtaagcccccattcttggcagcttccacatagtgttgggcctgtgattgtatagaagacaagaattgagtttggtgaacttctgcctagatttcagaggatgtatggaaacacctggatgtccaggcagaagtctgctgcaggggcagagccctcatggagaagctctactagggcagtgcagaagggaaatgtggggttggagcccccacacggagtccctactggggtactgactagtagaactgtgagaagagggccactgtcctccagaacccagaatggtagatccactgacagcttgcattatgtggctggaaaagctgcagacactcaacagcagccatgaaagcagccaggaggggcactgtaccctacaaagccacaggggcagtgctgtccaagccatgggagcccacctcttgcatcagcatgccctggatgtgagacatgtagtctaaggagatagttttggaactttaaggtttaatgactgccctattggattacttgcatgaggcctgtagcctctttgttttggccaatttctcccatttggaatgggtatatttacccaatgcctatacccccattttatctaggaagtaactaacttcttttattttacagtctcataggtggaaaggacttgccttgtctcggatgagactttggacttggacttttgagttaatgctggaataagttaagaatttgggggactgttgaaagggcgtgatcatgttttgaattgtgagggcatgagatttgtgaggggccaggggcagaataatatggtttggctatgtttgcacctaaatctcatcttgaattttagttcccataatccccatgtgttatgggagggacccagtgggaggtacttgaatcatgggagtggttaccctcatgctgttctcatgatagtgagtgagttctcacaagagctgatgattttataaggaggttttcccccttttgctcagcacttctccctggtgccaccatgtgaagaaggacatgtttgcttccccttctgccatgattgtaagtttcctgaggcctttccagccctggtgaactggagtccatgaaagatctttcctttataaattacccagtctcaggtatttcttcatagcagtgtgagaataaactaatatataagccttattattctcatgtgatataacaaaatatattaatgtagatgtgtttacagacatcttctttattccagctcaacagcccaaattcttttcaccttctgtaaagaagagtgactggaagagagactaagttaattgagataattaataagtgagtgagagaataaatgaattatagaggaggaaccaaaagcacagagctggaagtggaacaggaggttctcagcaattttaaaagtgaaggcaccgtagcagtggaagtatataaagggagtaaagtcaggctgggaaaacagaaggcaaaaatagtgttcatctagactgtgtgtcagattacttctaatatccttcaaggtacttgagtgaggaataatttcctcttatgtttctattggtattgggttgtccttttggatgaggctcagctcagagactgaaccatgtgatgtctgtgtattttagggttgcactcactttgcattaattttaactgagagttaaaggggttaagtgccttgcctaagatcacatactcagaaaatgcagagagcttactccagcccaggtttgttcatttcagatacattagtctcaattcagctttggttgaagtcacctgtgatgaatttgttgcatgatatagttttctgggggaaagatttcttttaatacatggtaagtatatagtaccccttttatagttggatagattagttctttaaatttcttttgtaaagaggatagattagtaatggtcaagtgtcattgagtgattcagacgaatagttccatgattaaatcttgtttcctttactttttgtataatgctaatgtatcccttaaaataaaaactccatttagttttcttcagttcatttaatcatggcattgttactgtaagaaagttcttctcctaatggtttctaattgctcttaaaatcttgtttgaatcccagaacaaatctctgtgttatatgtcaccagtgacccacccttactttctctcatttactgcctttcataagcagaaagcatttattttttgggtatttttgcttattttttaaaaataaataacattgatttttaatcctgggatatggaagatagtttaaagaaaacagcagtgtcggtggatagcaattaccaccaacaaaatatcttctgggtatttgatctatgaactttgtttgcactcctgcccacatcagtttttgtaacccttccaacttcctcctaagggcaaactcactgacatttccacaactgttcacctttctgatcctgataggattactatatattttgtttaggtttctagatatgataagactatctacctatccaacttggatctgtggcactttattttcctattaattttaaattcaggatttaaaaaagatacttacatagtgataaaatgagttgactcacaccctgcattattctaaaccaaaattaagttatattaatacattctctttaatcaagggtaaattcacatgccccattgtggttagtgaagtggtgaagggaaagttgaagccaaacagcctatgtcttaattctaactcagccactaactagctgtgcaatcttggacaaggccctgaaactctctgggtctcagttttctcatttctactaaaaggacaataatagtacctattacctagagttaggaagatgaagttaacaaagtgatagtgtattaaagcgtacctgacacataggaaacattcagtatatattgtctgctattattaaagctcctacacttattaggtaggtgaacttaatcagattatttgactttaataaacagcaatgatcatatttataaagtagggattgtaaaatataatgcagtgagtttacaagtgtcataatgtgaaatatataaatataaattacatatataaaatatataaatataaattacatatgtaaaatatataaatatacattatataaattatgtatgtaaaatatataaatataaattacatatgtaaaaagtacatagccatgttttgactcataaagagcattcattaaatgtggttacaatttttagaagacattatcagtaatattatcagtaatagaataagacctacaaaaaagggtaggggagagagtttcatgttgtataaggggagtgttgatttaaaagccttagattaaaatctgcaaatgaaactaaattaaaggtgttttgaagtgattttaaccgccaaacaaattgcatttaatacataataattactttattctcccattaaaataattatttttaagtgaataacagcttctttgaccaccctacctgtagttgcagtaacagtctaccagttgtctttccaaatttgtatgatgtcatcagcagcttaatagagcattagatgagaatgtctgagcattactatgctgactttgtaaaattgtaatccaaaagcaaagaatcttgacagcttagacagttggtttgatcttattattaatgaacagaagatatatcttaggctattttaaaagtgaatttataataagatttctacttcctatgttagctagagtaaacactagctaataaaccaccctcctaaacctcagcaaactagcccaagaaaagagtttaattttggtattagtattgctcactcacataaagcccaagcaattaggagcagaggaagggatgtgagggtttgctctatagagtcatagaggatccaaggtgacagagcctctgtcatcttccacacaggccttccaagatggttctagccaaatccagctagccaacatctctggaaatgacaagcatcacttttggtcatatttcattggtcagaagttagtcagagggtacctagttgcaagggaagctgggaaatgtagtctggctggcattgctttgttgcactaactcagtcctgtggaaaaggagcacaaatatttggtggacagtaaatgatctgtgtcatatccttattactcagatccatagtaataatgtctgtttttatctccttttctaattcctagtaaagaagcaatcaaataaaaagaaataaaaacactgaacagtatgtgttcatttgtctcatccattattgtatatagtgcctgatacagagttcagtatatattcagtatatatagtacctgatacagagttcatgatattcaataaatatcatgagtgatcaaacacatattctctgccttcttctcttcctcccttccttttttctctttttcttgcttcttttatatctctttctttttttctgatcccaaacactttagagtctttaatttgagctagattctatgataagtgattgaagaatcaaagacatatttaaccttggggaaagtcataatgggaataaaggaaaaaacattaatataaagtattagtaaacatttctaaattactgatttcattaaaatatttaacagtcttatgaaagactaaagaatcattttgagttcatctactaggcatggacaagccacttcaggaagtttaatatccttctttgtgcctttgggtttaatctgtgctagtgataccccagccttgacagaattgctgccccaatggcccaggctgtgggattctgcacaggaaagaccacttcatggtgaaaattctctaaagttttgctgtgaatcataccataacctaagatctgtgttatggtaaactggatactgtagtggtggaggatgtctaacttcgttttgtgtttcacagagtttcaagagttttcctgtaagcctctttagtctttgtatatttaatgtgctccaatcctacttacatctcaactgtgttctttctgatggcgatggtgatgatagtgccaatcatttatttagcactaacaactgtgtgctcgacactgtaccaatattattagaactattatttcttttactcatcacatcagccctattagatatttagagatttggaaaattatgttcagatagatttggtaacttgtctaaggtcagacatgttaggaaaaggcagagctagaattcaaatacagttttgactgagctcaaagcttgtgtaatcaccacttaggctgatgatttgtttaggctattgagagagaaagattattttatctttctttttttttctggaaagagggatgtatacagatcttttagtagtaaaattttgccactacattcagtgacaaaaacaggagttacttttgcaccaacctgataactcttcaaaatgtttggtgaggctggactcaaacataagtgcatggatgcctgatttttttcccccagtattcaagaacctcagggttttcctgaatgtgctatagacattccagggacctcctaagttttgaacattgcattattatgaagattaggtccataagttttatcagattttctaaaatacgagtaaacattttttaaacccaaggtttgctgccaacttctctcctctacagatcctggaaagaagaaagaaatggcttctaacaaaaagaaggggaggatttccagctcatttctaattcaggctcattggagaaggaagtggcatgggtgacgataagcagcagtttttatgtctgaaggaaactgaaaacagcatctcactggggtggccaggagctcttctgctgaagtctctgtgtatccagaatgcctgggattggattcttgtcctgttgcctctgacttcctagaagtggcctctgggccgtctttatttattaaatcatctgggtatgatctggctctgatattttggcattcgggagtggcagaccaagctcaaattgcaatagtcctttaaaaagatgtttctaaaagccagatatgcactgacatttcagaaagaacatttgtgcctaatttccagctgccaagttatagttcatcattcagcttcatattggaggccttcaggctttgatttatttaggaaacattggtgaacaatgggatcatgatctgcaacatgacagatgtaggaagtccatgtcccctaaaggaggttttctggagactcctaacaattaagagaatctgttctgtttctaagttgacagcaaattattgaattctgagtatccagaatgagtttggggagtaagagttgtgaagggcagacattaactgcttatttaagacataatacctgtcctttggaaacttatggtttgttagggggtagtgtcctagaaacaatgtaagacaatttgttaccaaatgataaatagaactttaaaacaaaaattttcctactgtcagggaaactaagttttccttttctttgaaggcatggagaagtgccgagcagtgtgttacttttcctctattccctggttcgttcctcacccacgtcagtttttcttcatatttgtctttattggaacccacaaagtttattcaaagttattatcagtttcttcccttttgtgaagaaaattcaatttttatgaattagatttttaagatggcttgtaatgtacccatacagccaggtataagaaattacctggtagcttcactgatgcagatgacagatacctgtggggacttacagtctagttgggagagtaatcacacacatacacacacacacacacacacacaccccagatttggcatgagaagaacaacgctgaagtcgatatctgcctattttgtttataatggtgtgaccttgggcaagtcacttaatttttcaatgtattttctcatctataagatgggagatatcttatatcctaaggctattgattatgtcagatggaatctcatctgagaaaataccttagaaattgtacagtatgataaaaatattgacttttattttctaaatcatacatagcaagatgcaggactagtttaattgttgtcacttttagaatccgattttcacatcatcattccatttcttatgatatttaacatgacaagcaaaagaccttgttcaaaggggaagaacaaataagattaattctctgtaaatcctttaaaattttattatccatctcttcactggggaaatgtctagatacattttcctaagtggttccatctttctgtaaatggctattgacctgctgagtgcagttttgctttcagagaagcattgcacttggtgtgtgatttgagtttgggatcatgaccttatttcctttgcacttgattgctttacttcaccaactgcatccctgattttgatattatctgtggctagctcctttcatgattttgggaatggctacctctcagttttctgaatattttttagtacttgctgttacaatgtagacattgcaataatgttctaaaattatatgtacatttacttactcaacacaaatttaaagagtacctgataagagctggtactctgagtactgagcactgagtacctggtagaatcattaatacagaagacaaagctctggcctcaaggattctgcagtacagcagcagggaggtaaaacacacataccacatttgtttactgcaagtgtgggaggtagataggtgtcccctaaaaacatgtgttcccagaacctgtgacgtgaccttacttggaaaaagggtctttgcagatgtttaagttaataatcttgtgatgagatcatcctggattgtacaggtgggccctaaatccagtgaaaactatctttgtaagagacagatgaggagaagacgtagagacttgtgaaacagaaggccatgtgaagacagaggcagagattggagggatataaccagaaagaatgcccataggcagcagaaattggaagaggtaagaattggattgttgcctaaagccttcagaaggagtgtgaccctgtcagcatttggatctccgactctggcctttaaaactgagagagaaaaaaatttctgttgttttaagccagtgagtttgtggtaattttttaatggcagccatgagaaacgaatacaacaaggaacaggataatctacaaaatacatgaattatacaagagcatcagaagtttgtggaaatttagtataaaaaacacctcttattgaaagtgtgattgttactatacagtcagtccagaagcactgaattatgaaaatatcattgcctggtatgtgtcagttatgtttataataatataaataatctaagcacacattgtgtcctgtaattttaattttactctaacatcccatgcaaaggtttaactgtaggtggccatttcatgaaacaaatgccaatttctcatggaccaatgttctcccagcagaggaaatatatcttcctgcccacactgggctacaacatcactaaaattacaagcagaaaggaggtctgcatttctatagcctcttcttttcttatctagtagtaaatggttataaacttgacattttccagttacaaacataagtaataatattgtaataacaaaagggaaggtccaatcctatagatcccactgatggtgatagagtaaatcaaggaatttggaagaagtggtatctagtttcacaagttgaaaaaccagaattatcttcaggcattcataatttcagtgtcatgggttaaggtgtttgggggcaaaatgagtttctggctgtgggatggatttgagtggtgttagcaatcattcaataacagaagccactgaagcagccttcgtctccctaatcaaaatgctgccatcataccattttgctcccaaaatatgctaaaagtaaggcaccaacggtaataagtagtataggtaatttttaagtaccataaaagtttacaatattaacagttacatttgttaattttgtctggcttagttggtggtgacttcagatggtaactgggtggaataagacttctaagcccacataagacaggatggtgtgatctttctgggagggtgccacgtctgtccaatattgatacaatagtgcaccagtggcagcttcttggttgggccaagtaagccttctcaatgtatttactccttcagtatttataacaatcaggaagctgtaattattgtccatattttactaatgaagtaactaaaacttagagaagataagcaatttgtctgaggtcatgctctagtagtgagcagagccagaatctgaactctggcatgatgactatagcgtctgtgtttttatgcattactgataggtatgggtggtatactggagacttagtgagtatttaggtgtgagtaacgtctacagtgacgtcagggagctcactgtacatccatgacatgagaaataaaattcccacgcttccctgtcttgaagctgaggcaatatattacatgggttaactgacaattcagacagagtgagagattcattatattcaccacaaatgaacacagatggacactcttcaaataaagcttcctattgaattttaatagtgctcttctgcagaacacatttgaaaaatggatcatagcatattcatattttcctttagcttgccaaatgtgagatgattaagaaacctgcttaaactttaaatattcttaccatacacatgcatttttcaaatgtatgcgtctgcaataaatatttgttaaatgaatatgaatgtatatacacaaacatacatgaagcaataggcgcacacacatttaatttgataaatatttgttgagtatctactgaatataaacttgggctgaagagttatggaaatacaaagacagaattcttttctgttcccaagaagctttataaggggaagtgagacatgctcagtcttgttctggtggcagctctcaaagtgtggtctctggctcggcagtgttggcatcacttggggacttgttagaaatggaaatgcttgtgccccaccatacacctgctaaatgagaaactgtggctgggggtctagcaatttatggttgtaaaagtcctccagggaactctgatgcacgttaaaatttcagaaccactgggcacaggaacgctttaatgtgctaaaggatgctaaatattactttcacgtggagacatctgagaaggcttgaagaaagagattgtatttgagcagagtcttggagaacaggtagattttggctgatagaaacagagaagggaaataaagtcaaagagaagagaggaagtcaacttagctcgtttgagttggcagataggctgcccatggatgaaaacccagattaaaatcaggcagtggaaatccctgagcaacacgcttgtgagtttagacattgttctgaaagacattggcagtcattgaaggtttctgagtggggaagaagtgtgatcaaaactaccttccttttttttttttcttacccagtgaatgtaattcagcacttgtactgagttcatattaacagaacttgatggttgtaaatcagtcttttcttcctcattaaaatcacttcaccattaagaattatctataggttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaagaaaaaatgttgctgcttgctagtgcattctttgttatgtagcaatcagaaggatgactgtgctctgaagtggtgcaggtggcctcttctgatactaattccagcgtctcaactagttcagcatcaaaagggagttctctggaagggaaataattctgtccctacccctgattgctcctatttgcccagcattgtgggcacctgcttggccacccaccttccttttctttgccatccacttgcgtcatctttctcttcccctgggtcagcctgtatatttcaatctatccacaccctgcgcaagctcattcattcatgggctttctctctgcaattttcattgtgcctccctttgttggcataattgattccctgctttgcaagagcaggtggatgagttggtttattcctttaaaaaattcctcctcttttctctttcattgctctgatctttagtcaatctttggttcagccagcttgttctccttctattgactaatctctctctgtatctttcataatggtggtgggagagtccatgccgaatctcctgttggttgaagaaggtgaaagtcaattggtaaagtcactgtgatttataatgttcaaactggggagggattgagtcgtgaagaccagaagtactgataatcatttagcttatttgctggaaggctccactagaccctaatgaaacaatctcatttatcttccccacatcctaatggaattgcagaattaatagtaaaaccattaagccttcttgagcatgtctcatctaacactccaggatctttgttacacatttttatttttctcaattttggattttttgagggtgcgaatttacttagctgagaaatttagaagtcctttattcagtctagtataaagtgtccagataaaaacataccttagagatattgtgggtgcagttccagaccaccacaataaagcagataccacaataaagcaagcatataaattgtttggtttcccagtgcatataaaagttatttttactctatagtctattaagtatgcaatagaatgatgtctaaaataaaatgtacataccctaattataagtattgtgttgctaaaaattgctgatgataatctgagcatacagtgggtcataatcttcttacttgtgaagggtcttgccttgatattgacggctgctcactgatcagggtagtggttgctgaaggaggttagggtggctgtagcaatttcctaaaataagacaacaatgaagtttgctttatcaattaactcttgcttttatgaaagatatctttgtagcatacgatgctgtttgatagcattttacccacagtagaacttctttcaaaattagaatgaattcactcaaaacttgcaggtgctttatcaactgaatttatggaatattctaaatcctttgtagtcatttcaacaatgttcacagcatctttaccaggagaaaattccattttaagaaactactttctttgctcatctatagaagcaactcttaaaatccattccagttttatcatgagatggcagcaattcagtcacagcttcagtttctacctctagttctagttctcttgctacttccaccacatctgcatctactttctccactgatgttttgaacccttcagccatccatgaagattggaatcttttccaaactcctgttaatgttgatatttcaaacttctcccatgaatcacgaatgttctttatggcatttacaatgttaaatcattttcaaaaaattttccatttgctttatccatatctatcagaggaatcaccatgtcagttctagccttacaaagtgtattttttaaataataagacttgaaagttgaaattattccttgattcatgggctagagaatggatgttacgttagcagacatgaaagccacattaatcttcttgtactcccatcaaagttctggagtgactaggtgcattgtcaatgaatagtaacattttgaaaaaaaaaaaaatcttttttttttccttagcagtagttctcaatagtaggcttaaagtattcagtaaaccattttgtaaatagatgtactgtcatccaggctttgttgttccatttacagagcacaggcagagtagattttgctaaattctggggccctaggattttttgaatggtatataagcattggcttcaacttaaagtcaccagctgccttagcccccaacaatatagtcagcccgccctttgaagtcaggtattgatgtctcctctgtagctataaaggtcctaggtggcatctttttcctatataaagctgtttcatctacagtaaaaatctcttgcttggtgtagtcaccttcatcaattatcttagctggatgtaacggataacttgctgcagcgtctacataagcacttgccgctttaccttgtgcttttatgttatagagatgatttctctccttaaacctcatgaaccaatatcttctagctttaaacttttttctgcatcttcctcacctctcttagccttcatagaattggaaatagtttgggccttgctctgggttaggctttggcttaagggaatgttgtggctggtttgatcttcaatccagaccactacaactttctccatataagcaataagcttgtttaactttcttatcatctgtgtgttcactggagtagcacttttaatttccttcaagaacttttcctttgcattcacaactaggttaactgtttggcacaagaagcctagatctcagcctatctcagttttcaacatgcctcactgagcttaatcatttctagcttttgatttgaagttagagatatgagactcttcctttcatttgaatacttaggcctttgtgggagtattaattggcctaatttctatattattgtgtctcagggaatagggaggcccaaggagaggaagaaaaatgtgagaatggccagtaagttgagcggtcagaagacacacaacatttattaagttggccatcttatatggacatgatttgtgttgccttcaaagaattacaataatgacatcaaagatcactcatcaaagatcaccatctcagatataataataatgaaaaagttttacgtgttgagagaattaccaaaatgtgatgtagtgacatgaatcaggcacatgcagttagaaaaatggtgtggattgacttgctcaaccaacggttgccccaaaccatcaatttgtttttaaaaatgcaattgttgtaaaatgcaaaaaagtgaagcacaaaaaaactaggtatgcttgtgataggtttctctcctattctttgaagaggcttttaaatagagttgattgcatggcattgcctagtaaaatcattttaaactaatatgaaattatataagctctgaacagggcatttgatgtccactagggaaagtaaaacatattttttatttcagcataagaagcttatctcttccatcttgtaaaataatataataataatagaattagttaaacatggtgattactattacgtattttatgattccaataattcaagcacagacactatcttgaatgcgtcctagtatattcagctccacaatgatgcctagggtttcatgttgaaggctgtgaagttaacaaaggaaaatggagatctgattactagcttccagagattggttgagaattgagggagaagagagatcaacattatatatttcacatggcagagggtaataggagcttttatagagaggcaaaatgcattggtagaaagagaagagagagcctaattccacttgctaaaaatctatggaagccacctaaaggaagaatgaaaaattgaatgtttatcaataagttggaaagaggagaggaacattatgggcagagcaaacagcatagaaatagaataatacatggagtatttgttagcattcagagggaatggagatgacgggaaatggtagaacatagttagaaaagtaaattgggcagaattggtgacaggggattcaatttggtaagcagtgggtaaccattcatggctttgagcagagtttggcaaactatgatttgtggaccaaatccatcccattgtctgatcttgtaaagaaagttttatttaaatacagtcatactcattcacttatgtattgtctgtggctgctttcatgctacaatggcagcattgaatagtggtgacagagactgcctacaagctgaaaatatttgatatatgactttttacagaaattttaccgatgtcaggattcactttaataaagtgtttcataaagtgtttgtttgtgccgtgatgggccatccaagattgtaatgggcgatcattggaaacaaagatgcttatagagcagcatcttgcatgtcacaaatatttgaatgaatgaaaaaatgcatatttctgttaagacatcacagtaacagtaggagatattgctttttttttctttctttttttttgacaagaccaatgtgaaaataatcagagagtggttctctggaccacatcctgttcttcaggggagagacattgaaaaacatcaggaaaagcttatccctagaattgattcagaggacaaagctacagttatgagaaaggccactttggagaaatgttggataagatgtccagtgaggcacagaatggggtgacactgggagtgacaggatcttgatggactctggccatggcacttctcaaacgtttttggcagtcctatttctattttcacagactcctccacctccactctgtcctggccagcacccagttctcaagcattacacatttatcccaagtaatgcgtagggagcttcctttcttgcacctataaattattcactagtttcagattggggtgaaaagaggaaaacataattaatccagaattatttcacatgtataaattccttgcttggttttgtttcatcatcagggcttccttggccttccatggatggcatataccttattaatttatgcttagcaatcttttgaaaataatttttacatgggtaactcactgaaacatcatggcatttatctcacatcatgtagttttgtcagttttgatgttagagaacgtattctgccttacttttatgtagcaatgtgaccaggaaatctcatgtaaaatctatgcctccctaatatgcaaaaatactgaaaatgagcacctcttctcccttccttcttttttaataaatctagtaataatagctggaataatcacaggatttctaaatggagtcagcatggcaaaggaaaatgttggtgatatatttattaagtccatagaagttaaacttccggagagctcccaagctaattggtaccccttgttcaggactggggactattaactgagagaattcattgggtgttttaatatctagccttttaaaatctattttaaacaaggactttgaaggatgactgaaatgtggttaaatttccacagagaacttacaactccagcaatgggaactccccaggtacagtgatgatacgaattgtgttggatttcttgaatttcatcttcaaagcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctctatattccatctctactttttgtttataacaagttatttactttgcccatctatcttttaagcaaattatcttgattggaaataactggaatgcttgataattatataagaaacttaaatacttggcctattcatttatcctagagttttagggaacatcttggtctagcataggcattctcaaccatcatattgaaaaaaattgtggagcattatagcacaaatgattttacaaaataaaatgattgttaaaaattagaataggttcatagtagcctcacgctctgggttccatcatgcttcttgggagagagagaaagagcagactggctggtcagaaccctggctttgactgaagaacacattctgcctgtaagcataatttctcagctctgagccagagaaaagcagtgggactcttttctctaggaaatacagtctgcatagatagaatgaagcagaattggagacacataggaaaacaattatccctttgtattagtttatctaatcctctgctttgggaaaacaggaagagagaaaaagaagagggaggagagggagggagctaaaaacaaaggaaaacacttcacaagggtttgccctcccccaaaaattcaagacatgaaatagaatctatcacatatgattgggagccttgtgttctggttttctccaatcctaagcccaagaatttgttcctcctgatgctgtagatagtttcacctgagaagattttactcacctctgcgtcccattatgagatgggaaacctggcttctgccacgtgggcacagagtagatacccactagattttgttgttttgtgtgtatggttgccagggatgatcagtgccccaatattcttgccccatcaatattcttcttagtgagatttgcaaccttttaagcattgggaacttaagggttattatgaatacctgtcattttaagctaatatacattctttacagaataaatgcaaaatgttcacattcatgagaaaaaggaagaaacttttagctgacacataccattttgcatgttatataaatgtattctgctcagtacaaacatttttgtgaacttaaaaaaaatctcttaaatgtttctataaaagtactacttcttgaagtttatatttgaatgaaaatacctcaaattcttttctaccctgacttagaactatataactttaactctctttttcatttttaaagatgtgatattcctctgatgagataacgtggagctttcctctaaaattttcttgtgttcagaccttttttttctcttccttctggtcttcaaaaagctataggaatctgacctaggaacactgtttcctcaataattggcattttctattttcactttggttttccccaacttaattgatgagatatataatctttctccatccaaagaaactacaatgactgacactaacatttttgaacccatctatgcccatttccatttttagttctacaaatgttctgacaccattttttaaaaaatcacaacaccccaaacagtgggttctatttttttttctattgttatagatgagtaaactgacacctaaagagggcccttagcttgtggctggcatctcaggaccaaaatgcctgcgtttgaagcccctgggaatttggcctttggagcctttagcagcttctaagcctagtgagtttgtggcttcaggtcctgtttaggtcctgtttctcatttgtggagaggttggtcttgttttgaaggcagcaacctccttcattttttttcttttttttttttcactatctatcattactacgtttggtgccaagttggggcctcaaattttgaacttaaaacatgacatgcctggaaatccttttctctctcttcttctgaagggtgtccataaagtctgggatgcagacaaatatatgtaatgtcattaaaatttttacaaatctgtaaaaaataaaatagtattatcaatgttttcataccttacagatgcccttcactttaaataaagatttcctgagaactaaaaataaaaataccatgtcctcaagtttggattagtccagggagtagggagaagggctgagaaagagaagggtaaaattatctattcttgacatcactgtaataaattgattgaactgtactgcatattgaatgcttgctcttactagggtctcttcataaatcatctcattattcctcaaaataagtcagcctgctaggtttgatgagcccatttgacagatacacaagtccaaggacatcaaatgactcgcccaacatcactagggcatgtgggctgaatgaggatgttcagtctggtcacatcaaaagccctagctcttttccctataagctagaaataatattccatcccttttctcacctacctcccagcaaaaacaaatgacataaaaatatttttttctatctgcttctgctcatgatacctttaaaatgccttattcatcaattcattccccatctcaggctcaggtaacccttgatgggggatttgtatctaattttctctgtatttcttgaaccatttttttttccatgtgtccatctctatggatccaacctcatgatttcctggaccatttaaattgtcttttattctttcttttttctctatcacatatcttggctctaactcacctgctttccctttgtatttctcttttaatattttacatgtatgtattaccccaactagacagtgttttcaagggagaacttaggaatttttcatttctttccaccatgacatcagacatctttctgatgtcatagcttatgaaataaaagtctataagtatgtgacctgggtaaaacataatcattttgagacttaatgatatgatctctatcaaagttattgtcaactgcagttcattctgctgttatttttatatttgatgataattcagaatttcatgtccccttctataatacctcacatgccaaacaaattaattgtgttaatgacaggtaaggaagctcctggtcactttccttccttgcttcagacccagcttcaaggtgggccagatggggcacaggctgcctcctctgtctgggttcgagttacttgtaaccatgtctgactgtcctggggtgcctcttagctccagttaatttctgaatcctcagcaagttttaaaagtctgagcaagaatttcctttcttactctgttgcttcatctttttcctttcttctctcaaatattcaggatggaggagaaacggcaggctgagccagcaatccatcttacttgaaacctatttgaaggttgtcgggtatgcaagggggctggaaatagggactgagagtttgattccagcatgaaggccaggcatcagtaccgatctaccttgtagtgtggtaaatagactttggcatcagctaaattatttctgtgagactgaagtattttgatcgaaatagacaagtgagcaaagggatttgcaaaagaattctgttttctggcacaggcatctcaatgaggccttgtgcagaatctcacatccgagcgccccctgatggcaacatatagacacgcctcactttctgtggccaaattactccatgaaaggaatagtttctatatttgactttaagaccttatttctaatttatgttttaacctgggatgtgtttggtcaccacttatgtatttgtttttcatatttgtttgatttcaaattatctgtgataacagtattagattataaagtgcattttatgaagctattttaaaataaggtattttcaaatgtcatttaatgttttcttggaaagattcaaagtagtagagtgcttgaggagaaataaaagcagaggaggaataaaaggagatgaaggaggaggaaggggaggaggagaagttataaataaagattagcccctaattctaaaacattttttcttgatctaaatatatgaacaacgaagtccaaattatttaatgtttcccattgactataggatgaaatttaatactttagcctgatgtacaaggctcttaaagatctatccttgtctaactgagtccagagccaaccctacagctgcccaccttgaattttatgctctggaaatactaaatgattacaattacctaaatataacatagttatattcaggaaatacatatattaaatattatatatatatgtataatatgtaactatgttgctcatggatctgtgactgtgcacaccatagttccctctgtctggaacatatgtactgcctcttatcctcctgcaaatctcatccttttcaaggtaattctttcatttcagataaaatgttattctctctgtgaagcttggccgtgatttccctcaactcctgctctccacaagtttccactttgtactgagctcttacattgccttggtcattccctttctcttctccctacctatgttctgaggaaataaacaatgaagtttcatcttctttttttttttttttttctgagacagagtcttgatctttcacccaggttggattgcagtggtgtgattatagctcactgcagccttgatgtcctgggctcaagagatcctcccgcctcagtctcctgagtagttgggactataggctcatgccaccacagctggttattttctttgtagagatagggtttcgccacattgcccaggctggtctcaaactcttgggctcaagggatctgcctgcctcagtctcccaaagtgcttggattacaggtgtgagccactgcgtctgactgaagtttcatctttctagtccagcttagcacaatacttggtgcaggtgcgtaagacatatgtgttaaattgcatacttcccatttcctgaatggaggtgaaataaaggaaacaaaagttaaatacatttttcaggagatacagaaatttgtaactcgctgaaaaagtagctttttattaggactttgccttttaaatcattacacactttagtctttcctcttaaactaaattactatttattattgactttacagaagaagaaactcgtgtcatacttatatgactttttggaccctggtgacatgtgactaataggtaaaaagaacatacaatgctgggagcaatttgtccagtggcccaattttatatgatgcctcaaatgaagtgctgtttatgcaatgaagtgcgtttcttgctttgttagtagtcattgagcctctgcacacgtaaatgtgtagggaatgaccattgagagacaaagtgtttgtgatgttacccatttatagggtatatcaatagttcacatttacggcacactcctttgaggccaggcactttacacacactgtcacaccttatcctcaccatcacagtatgacattaggacaattatgtctatttgcagatgaaactgtgactcatagagatcaggcgatatgtcaagattattcagatagtaaaaggcaggcttgggttcaaaatcaggcagtctggtttacagagcctggccattttttagggcagttgttctcaaccaggggcaatttttcttcttgggatatttggtaatatcagaagacatcattttgattgtcacaactgggagagagggtgttgctggcatctagtggtagagtccaaggatgctgctaaatatctcagagtacacaagacagtcaccacaactgagaattgtccagcccaacatgtcaataatgccgaggttgaaaagacctgttttatgataataagccaggtagaattcatgacaattgagtttatacaccaaccagtccttagcctttgctgttttccgcctgttgcatttctttaagtgtcatttattttcatggctttgactattaactctatagagatgatttccaaaaatcaaatacagatgatttctagagagaacctcaacctctccctcgaattctagcttcttattttcaactctcaggaggccatttttatttgaatgatttgctgaccgttccagtaaattcaaagtaactgttgctcctaatttctccctctgtggctttgtcctttttatcctagatactgttattcttttcgttagccaggaatgaaactctgatttatttcctcttctcttttccatagttctcctgacttcctcgtctccaatcagttactgaatatgaatgacctttccctacacggcttttcatagtatattcctattttcccttccacaatgctgacctaggtctttttcacctaccatgtggtattactgtaatcatgttccagctaatcttctgactccattattttcctctttcaacatgatcctgcacaaccacccagttaatctcctgaactaactctttggccatgtatccttttgtagtgcctttctgccattgagttcagtgtggattgcatcttgtgtttaatattcttcaggatttggcctgcaccctgtcatcttcagttgagccaactccttgcattctctgaagtgtactgtgcctatttctgcctcctttcctttgcccagcctgtgttctacagaggatcaccctagctactccacacctacacaaaaatatcatattcttaagacctgatcttgaccatttaccttcactttagttcttcctgtttactgcgccattcaccctggtcctaagtcatatgttctttctttgtatttttatttgaatattttataggaacatactttgtcatcccaactggacagttagtttttgcaaaggataactaatacattttcattttctttctcagcacctgatatcataacttttttgaataaaagtctaactgtttgatcttggtaaatgtaatcattttgagagtttatcatgtataaaatgataaaagttgtaatgttgctgttctacaaagcctattaatattttaccaatttgcaaaggagaactaatacatttttcattttctttcccagcacctaatgtcatagcttttttgaataaaagtctaactgtttgatcttggtaaggtaaaatgtaatcattttgatggtttataatgtataaaatgataaaaaatgttatgttactcttctacaaagcatattaatattttcccaatttgaaagataatccataatctgtcgagtttctagagaatacatgaaaatactaaaactaaagtggatagagtttatgtgagtattatattcagaatcagtattaggggattaccaaaatcgttacttaaaccaagataaacaaaattaaagaacatacgatttggtggaatagaaaattgtaagtttaagggcagtggctaaaactggaataatttatgttctataaggggaatggctaaataaaattaaaaacacatttttaatgttattgatagaaaattaacccataaaaattggtgcattggtcattatttagactaatctgttaaagttgattatcgcacaatcatattttctcttagataaaagatttatgatacttagtaaaaatggagcagagatttcaccattatattatataattataatttcagtgaatcaactgcaaattcatcaaaggctatttacattctgcttcacttaaattttccagttttattttccagaatttttctttacactgtgccctgcactccaactagactgaatgaactaccactactttcttcccatgatttcccatatctacttcctctgttatttcttctacccagactgcccttcccaatagttttctctgtgtctacacaccttcctgacaccactcaaatatcatctccaccaccaacttgccttgatccctagaaataatcagacccttttctgaacacccttaaccatttattactattttgtggcacttatttcactcccacatccaatctgtgtgaatgggcatgacataacttttctaccaaacaatatttctttggggaaagaattgtctccagttatctttttttccctgatcctaggcaagcaaggccattgcaattgccgcacaaagggtggaaattgagctggtttcaaagaccagattcggaaacttgaattcattttctctgtttggtttcttctttcatacttgcttttcccacttggctggagctggggcctaggtagattcaggcttacatatagccatatgaacagaagggaaagaaaaggttttttttttctgccaaaacttttctattttagaaaaatagggaagggctttgttaactgtgacttggggcatgtgctcatttctggagcaataactgcagccaacagaatatggtaaaataattcgctcaatctgggctgagatacactccttaaagtcaaggactcctgtctgttaccgaagtagggaaaacagtgctgggcagacaaagaaactaccccataaaagtagaagatatctttcagagtctcaacacatataattattggcagtttctttaattatttttttctatttatttactattgaaattggattgcatattaaattttggatttagttttcttacttatcattatagtcagctttgttgcatggtcttatacattcttcttaacatgtgtggtgctcttcataaacatatgaggtgctttggaatagtatctcctgaacacgtcaagatatcaccaggaaacaaatttgactttaggtcacatggccacttttctgtctccatcacaccggttttctagctggtcagagtggggatagagtctaaaggggaaattaagtatcatgtgagctttgaattatgtaatgttaacaaatgtttaacattactattttctagagtggatttttgtaggaacactttccaacttgtatgcatgtttcccattccacatagagttcaaaatgtgactacttacagactgctttccagttagtatatttaagataaagaagcctacattacacaccttaagaatgtaggccatgtctacataataagaagaacatattttttaacttttaagtccaggggcataagtgtaagtttgttatgtaggtaaacttgtgtcatgggggtttgttgtaccgattattttatcacccagatattaagcctaatacccattaattattttttctgattctcttcctcctcccaccctccaccctctgaaaggacccagtgtgtgttcttcccctctatgtgtccatgcgttctcatcatttaactcccacttataagagagaacatgtggtatttggttttctgttcctgcattagtttgctaaggataatggcctccagctccacccatgtccctgcaaaagacaagatcttgttctttttttatggctgcatagtattccatggtgtatatgtaccacattttccttatccattctatcattgatggacatttaggttgattccatgtctttgttattgtgaacagtgctgcagtgaacgtaagtgtgcatctgtcttttgataagaaataacatcatacatgcaaacagctgctagcatgtctttgttaacactttttgtggcttaacatctttactaatatttatgattaaattcaatcctcttatttatttcccattatagaaacaagtagtgtagagttgtacgagactcctgaatttatttagtccaatgtttcaagcttttcagaggtttattttacaaacccatagtagtcagtcatgatactttggtttaaatacatctgatcctatcttcatcttgctatggggaactttctgtctcaccagtcagctttttccattgttaggtatttctgattgttggaacttcctcctcccaccagtctttttcagaatctactgtcaaatctgttctcatagcaattataatttttctttcagaattataattttaaaaatttgcacatttctgagaggtcttcaaaaagttcctggaaaatgtgcattatgaaaaaaactgggcatcacttaaaaaaatttcaccaagataaacttgtactaacttcttgtaacatgtctgaacaggatctagtttgagacactaagaaggataagacattggtttgaatagaggccctatcagagcaacatgaattctattaaaattgcagcaagaacaaacatcaaatttatggtgaggcttgggtagaagaatggtgagatcattgattctttatgaaaagaatggggacaatgccccaaagaaattagcagtttataagtagaaaactcattttaaggaggaacaagaagatcttaaagatgaagcctactatggcagaccatccacatccacttgtgaagaaaacattcatcttgttcatttcctaattgaaaagcctaggttattaacagcggaaacagtagctaacaccacagacatctcaactggttcagcctacacaattcttactgaaaaatttaagttgagcacactttctagttgatgggtgccaaaaccgtcgtacctagatcagctgcagacaaaagcagaactttcaatgaaaattttaaacaagcgggatcaaaatcctaaaacatttcttagaagagttgtgacaggagatgaaacatggctttaccagcatgtaccatcctgaagacaaagtacaatcaaagcaatggctaccaagagcaggaagtggtccaatcaaagcaaaagcagactggtcaagagcaaaggtcattgcaacagttttttgggctgctcaaggcattttgcttgttgactttctgaacgtccaaataagaatagcatctgctaatttagtacagtgttttgagaaagccaaatttttagcagaaaaatgcccaagaaagcttcaatagcaagatctttttcattatgacaatgttccttcttgttcttctcatcaaacaagggcaattatgtgagagttttggtggcaaattattaagcattcaccttgccatcctgatttgacttcttctgacttcttattgtttccttgtcttaaaaaaatctttaaagggaatccatttttttcaattaataatgtagaagagattacattgatatggttaaattcccaggaccctcaattctttagggatagactaaatggctggtatcatctctgacaaaagtgtcttgcacttgatggaacttatgttgagaacaaagtgtgtatttttaatttttatctacttgcccatgaagttcatggagtgcttttagatctgtctttttctctgtctgtttatctatctatttatctgtcaatctgtctacacacccatgcatctactatccacctacctaccaatcatttattcatataaatttgtttaaacacctggaaaaatgattatatctccctcttgccttctctttacgtattgctaactatactcagatatttgagtcattcttagtatgatagttttcttactgttgtccattcctgtcttattttttaatgttctggttcttttagaaatatgttatccaaagtaaacccactgttcttgctgtaggagagagttcactgggcctttccatgctgtggtgtggacttttacttccattgtagatatagcagaaagagctcagtgaccgagagcctgactgcttggatttatactctgcctccacctctcactggcaatgtagctttgggcaagtcacatatcctctgtatataatttttctcatttgtggggtgcagatataagtggtggctatcttggagggttgcaaagaagagcacttccttggccaatagtgtgccctctgtcatgaatatttccctgctatcattgtaacttaacttttgttgctattttaacaaccaaatcatgactatttgttatcacttctgggcctttaaagttgctgcttttcccacctagagcattttcccccaagatagtcacagggctggcaacctctaatcttttagcagcttgaatgtcattcctcaaaaaagcctccctgactgctggttctgcccttgccctggtcactctctagccctgggctttatttcattttctttatggatcctatcaccatctgaaattcttcactaatttgcttgattattagctttctccctctgctgaaatgtaacacatgtgagaccagagcctccttagtctcatttaccaatgttaacagcaaccagaatcgtgcctagcatatagcaagtgcaccagaaactttgttgaaaaaatgttttgggtccatgaaaacttccaaacatgtttcagatgttcagatgactttttctttttaacttgctctcctccaccccatatcaatgcaatggatatttgaaaactaaatccagaacctgaatttatcctcaataaatttgacttttcatattccattcagagttctggtattcctatattgttttcaatttaatgctagactttatattaattaagataattttatggtaacaataacattatgcatgcattgagtgtttgctacatatgaagcacttataaatttttacatataatctcatttaatttttaaaacaaccctatgaaatacataacatttttattcccatttttataaatgagaaagctgaggtacaatgagggctggtaattgggcaaagtcccacagctagtaagttatagagttgggatttgaacccaggccttcagatatcatcaactgaataattcatcagtgtcatgaggaattttctgaactttgtatgacttgaaactttgtgatgttttgtctgtatctatatacaagtcatgataagatgcctcataataataccaagcctctgtgatattccagtactttttattctggttactactgaaccaagaattattatattttagtcatattgtcaatgagttcactacccacagagctgaggacataaggctgctgtggaaaagggagtaaacacttattaaaagccaggataggcaatgtggcattcctgtaaagcactaattagtattttcagcagaaatatgttttaccaaacctattttgctgtcatttgaaagcatgttattttctgcatgttcacatttcaccttgcttcccagagtgtttacagcaacttgccacagtaacacatactaaaataatggtatgatacacaagtaagaataaaaaatgtgatctagagaaaaataagagttaaacacaagaccctagggtggaggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaactcgtcatttagcattaggtatatctcctaatgctatccctccccctgccccccatcccacaacagtccccggtgtgtgatgttccccttcctgtgtccatgtgttctcattgttcaattcccacctatgagtgagaacatgtggtgtttggttttttgttcttgcgatagtttgctgagaatgatggtttccagcttcatccatgtccctacaaaggacatgaactcatctctattcttttattagccaccaggaagctttaaaaaaaatacccagaacaaattggtatttttttttaaagcttcctggtggctaacaaaagaatagagaagcaatcagttcttactgtcagttagaaaaagctatcccagttattcaagagaaacacagtatagcttgagactatatgtctccataggcctttttgtaagaagtattcagtgatataatttcccctatagcagacctacaatgaactgcttagtttcatgtcactgctgctcatattgtcctttgctaaaagctgagaatatgacactaaaacgagattcaaggaaagaaaatctgtaaaggatggaaaacgcagatagtatgttcaaaaggttagatagaacttggaggatcatttattcttcttacatcctccataaatacatagcttacctgggattttgaataaatgtgggcagcagaccattcaaagtaagattatctggaaagtgcttggagtttctgagtggtttgctgttggatccatttgttttagaaaatgaatgagaatacatggaggattatagccttttctggaaattaaggacctaaccaagttttttgttttttgaattaaagggccctgtccatatctatatataagtgagaaactgactttattggatgtctctagtgtttattcattccttgttccttcgtttattccttcaacaaatatttattcagcccctactatgccctagatacctaagctatagcagtgaaaaagacaggtatgatctctccttcaatagagtatacattttaagaggcaaggcaaacactaaacaagatactaattatacagttacaatcttgataagatctactaaagacaagtacaggtcggaaagtaagcacaaaaatgagaaactcaattccatttttacagcttccttacattatagatgatgttacctctaagatttttttcttttttcttttcctttcttttctttctttctttctttctttctttcttttttttttttttttttttttttgagacagagtcttgctgtgttgctaggctggagtgtagtggcgcaatctcagtccactgcaacctccacctcccgggtttaagcgattctcctgcctcagcctcctgagtagctgagactacaggtgtgcaccaccatgcccagctaatttttgtatttttagtagagatggggtttcaccacgttggccaggatggtctcgatctcttgactttgtgatctgcctgcctcggcctcccaaagtgctgggattatagatgtgagccaccgcggccggccacctctaagatattaacagccttctaatcactaaatccaatgtcctcttctaatctttagaaatgttcatattcgttggcatgggaatataaccatgaggtttaaagtttctgcttgtgcctttgtttgtagcagataaaatcttttgtttaaaagaaataaagcctacttgaagtccataaagagaaaacagatgaaatctggactgctttgtttggagatgcctcatgggaaggtgggagctctggctttccccacacttggtaatctcaggatcgtcttttcttgatccccatggtgctagtttggaagccactattctagaattctcattattatcagctatttatgtattggctccctggcagccctaaagactctgcctggactgacacatcccagtcctattcccagttctgtgccggagtctctgaacacttcttgaactgatctgagccaagaaagaaacttggacatctttggatttgtgaaatccaaactggaccctcttcatttgctgtgatttcccacccatgattacagttcacactctacttactaccaggtctccaaccaacacctcatttattagtccatctcctgtgtgtgcatggattggtgagggaaattagaaggaaaggaagatgattgcatccatcaattgaatcaatgtattctgggctccaaatatgtgctaagcattgtccaaggaagctgagggtataactatgaacaaaagaaacaaaaatacctgcactcttggaacatacattctaatggaggatatagacagtaaatacatcagaaattaaaattgtataacaggtggtgataagttcgttggggagaaaataaccaaagaaaaaggatagggtatgtcagggtgaggaggaccaaggtttactactttaacgaatgatgtaaaagattgcctgagtgagaaggtggcatttgaggaaagatgggtaggaatgagtgatacaggtgtctgcaggaaaagcattgcaaacagaggaagcagaaagtataatggagcttagttaggagcctggtatgtttgagaaacaacaaagaggtcgtgtggctaaagcaaagtaagagatgagactagaaaagtggcagaggagcagatcctgaattgtcctgtaggccattttgaggactttgggttctactctcaggaataactgggaagaagagtgacacgatctgtcttcagttttgaaaagatcaccctggctactgtgtggaaaatggaatgaagggggcaacgggaggtgcaggaacatcatttgggagtggttgacacaaaacaagcaagcaataaggggaaggaggggggataatttgttcaagtaagcctctttctctgttccatttgattggaacaaatggtacaacttagcagaatgtccagtaatagaggagaaagcaaataaaaattcaaagatattgagatagtacctgagtggtaatttaattaatggaaaaggaaatctcagaaagagatgtttttgcctaagggctagttgtgaaagatgaccctgaggctcaataaattgccttccattgtcagtggtatgtgcgtgtgtagataattaaagaggtgagaataaaaatagagggaaaagtcaaggattgagttttcaattttagagtttctatatatggagtactgtgtggtttataaaacactggtatttaatatattttattactatataaatgaatgaactacgtttcccaaacatctttctacgtgtgaagcaaaaaaaaaaaaaaaaaaaaaaaaaaaccacacagaaaaaaaacaagcaagcaaacaaaaacagagggaacaagagtttagagaagtcaaagaaatagtattcaattttctgtttagtaccatttattcagtgttcagtgtcaatgaggttatgagaaatattctagatactggagatacaaatataaatgaaacacagttcttgcccttaagaagcccacagtcaaatggaaaatatatagaaataaatagcactgtaatgtgataggcagacaggattgcttaattctcactgaaagattcagatcagagttaccctctgtgcagcttcttgatggatgatggggagggccagcatctggggttggagaaaagaaaggtgggtctcagggaagaaattccatgtgccaagatacagaggggtaaaattatgtggccttttcagtatatgaaagcagtgattcacagaacttagatgatacaccttgacaagatactcaagactcccaagacaagacactcaagagagtgtcttgaaaatagagtctttaaggagtaattcaattaaaattatggcattagtgcagactgtaattcaatacgactggtgtctttgtaagaagagaatgtccctataagaagatactcaagaattccaagataagacactcttgtgtcttgggagaaattctcatcttgggagtcttgagtgtcttgtccaggtgtatcatctagtacagaaaatagctcaaaaattgtgatagccttgagaatatattttacattacttactgtcgaaactgggactgtttttatcacaaaaaggggcactattaataattacactggaatgggtataaattaaagcagtctggggaaacccaaacatatggtcaacctaatgatacctgttttcctgcataaaggggttataattgtactaatttatggtgcaaactgggtgctaaagctagtgatgagtttctctgctagaaaaatgttccaaagaaataaaccaagacagttaatgcagagttttggtagaagggataactacttttagatggtaggtcacagaagcttgtccgaggtgaggactttgggctgagtcctgaatacaaacagccagctatgggaagctccatggcaggagtgctccagggagagggaatcccaaaagccctttgtgggagtccttctgttagagaagacctgtttggatggagaatacaaaaccaggggggcttgggagatgaggtccgagacataaggagaggctagttcatgttcagccatgtacatgtggtggggaatttgagttttattctaattggtggaagcacagcaggtgatagagcatacctcacgtactagtttacaagggctgccttcacaaagtaccctggactgggtgacttaaacaatagaaatttatttcctcgcagttctgcagggtggacctcccaaatcaaggtcctggctgagttggtgccttttgagggctgtgagagaaggatctgttccagaactttcttcttggcttttagatggctgtcttctccctgtttctttacattgtcttcctgctgaacatgtctgtgtccaagtttcctcttcttataaggacgccagtcatattggactagggtccgccctcatgccataattttaattgaattacttcttaaagaccctatcttcaaatatggtaagcctctgtggtattggggtttagatttcaacatacgagtgtttggagggacagaattcagcccacaacacctcattaagcctggaagagaccgtaagaatattcgattaactggataagaagcacttaaacccaatttctaagaaaagagggataaaaaggtatactgtttccaggtatagtatgaaggtcatgatataaaacagaaagaagctttttagaagggaacaaaaaacactggggcttacttcaggagggatggtagaaggagaaagaggagcagaaaaaataactattggatactagggttattaccttggtgattaactgatctgtgcaacaaatcctatgataggagttcacctatacaacagacctgcacatgtacccttaaaccgaaaattaaagttaaaaaaaggaaagaagccttatacagaggactatatatagccttatataaaggactatattaagaattcttgtgagaagtcattatttaggtgtcaggcatctatagccatttaaacagagtctgtgtgtaacagtcttgagctgctgatgaaagaaggtgtagaagagtgttggtgccaagatctggagtggagtggtaggatcctgacctggagcacccaggaatgactgtcctttgtgcacaggtgatagacaaaactgggggaatgaggagttgaacatggaggtatatgaggaaggctcatccgctcttcagaaatccagaaacctaagtgtgaaaacacagatttgagggcctccacctgacttggtgggatgctcttcataggagatattctcctaatgtacattacaaagtcaatctaggagtaatgtaaaagtgatagttatcttaaacaacctgaatattttctagatatgtgattttgcaaaaataaaaaaaataaaaaaataaaaaaatgaaaaaaaaaaaaaaaggccaggcatggtagctcacgcctgtaatcccagcactttgggaggccaaggcaggcagatcacctgaggtggagagttcaagacaagcctgacaaacatggagaaacctcgtctctactaaaaatacaaaattagccgggcgtggtggcgcatgcccgtaatcccagctattcaggaggctgaggcgggagaatcgcttgaacctgggaggcagaggttgcagtaggccgagatcacgccattgcactccagcgtgggcaacaagagcgaaactccatctcaaaaaaaaaaaaaaaaaaaaaagagagagagagagaaaagaaatatctgtgttaggaaaaaagctaggaaaagctaaattctggtcatttcataataaaacgaataatgaaacaaacagaaaaatattttatgtggaagaacagaacagagaccttgggcagaagtaaccatgacacgttggggtttgtataagtaataaacgctgagatatatgccttaaactttagactgtctgagatcagtttaaggcaaagatagaatattatgactaaagagcgtaaaatgaactgctgagcatgcaagtaccataaaaaggcccttccttcagaattgagctgatccatattttttctcttgatttcattttctacttaggaactcagttcttgacaggccacatatacaatgaatgtcccaaagattgcaatactgtatttttactgtatattttttatgtgtaggtacacaaatatttactattgtgtaacagttgcctgcagtattcagtacaatcacaagctgcacaggtttgtagcctaggagcataccatatagttcaggtgtgtagaggttacaccatccaggtttgtgtaagtatgctctataatgttcacacaaagatgaaatcacccaatgatgcatttcttagaatatttcctcatcgttacgtgaagcatgactatgtaagcattgagaatatgaatacacatgatttccaccaagagaaagcatgtgatcccaaatataattggtaaactagtattaaaattttttatatgtctttctcaatatctgttatatgagacacacttgtttcacatagaacagatgaactatttgttttccatcactagaatatttttcttctaaaacttttgacctatttgggattgaaataaatgacttctaaatttccatccattgctaatatctgtaattctgtgtattacagataattggctaattacctgagtatggtgttgcttttttcaatttataacagtttagaccttttaggatacagttgttgaaatatggcaccaaaacactaagcatcttatattgatcgtgtgtcaatttacctaaccttggcaattattttcaatatctattttccaaggaaagaaatgagtagttattatcaaattacacaagtggagaagaattggagtttaggtaaatattttgttctaaaatatcaaatggtcatttaagctgaattgggataaaacaacccctatgaattttgctggatggacaccataaatgacagcaaccctgttcttctgttttcatcatagtcaaaaaatgctttagagtttactacttctacatatctcatttagttttcataatggagattttctaatgcatgttttatagatgagcaaacaaattgaagatgttaagtgacttgttcaaagtcatatatgtgaacacatattgaacataacttatttggccttattactataatggtcattagaatatctttaaaaatataattttttaatcaattgacattacacaatttttatttgaagctttcaaaattaacagtaataatgttattttattaagcacttattatatttcagtcacagtgctaagcacgtcacagtcatcatctaatttactcaatctgaaggtatgccattctctgaaaatggcaatatacgcttacaattatttgtagcatagcattctacactaaaaagatgaaataaagaagttgaaattttctttatcaattaggatagctaatgatcttctgtggcaacaatcagcatgtcttacagcttaaaacaacaacgtttacttctcatccaccttacatcctatctttggtgtacctggagctctgtctcatgtcgtccccactcagagactcacgctgatggagcagccacaatctagagcctggcctgccacagtggtagaggaaaagacagactggtgaactgtgcagtgatccctaacacttctgcccagaggtgatgccagtcaccttgatcgaagcaagtcaatggctacatcaaatatcaaaaaagtgggaagtgaaatcttaaaacaccccggaaaatactggaaatttttattttagttttacttgaaaaaagtataaattttgattttctgtattaaatcacttattcaaacaatgatttattcaacagaaagcattgaacactgtatttcttttctgacaaccacttctccaattctctgacaccaactgggtgcccaacaattttattcaattctgatactacctggagttagcacagatcccccaggttaaggactcagtctcacaagacttctgctactctagacaccagacactgtacatggagtgctcgggctacccacagttttgtgcagctgaccacaaattgggggttctcatgaccccctccacccctcagtttccataattcagtagagccactcacagaaccacgacatgttctttatttgcaattattggtttattataaaggattcaacttaggaacagccaaattgaagagatgtattggacaaaacatgaggaagaggacccagagcatagatgccctctcctggcacactgccctgccagcatgatgatatgttcaccaatctggaagatcctcaaaccccatcttttagagttttgtgtccaggattcattaaggtagacatgattgattatacattgcccattggtgattgaactcaatctccagcccttctctccaacccagatgtcagggacggggaccttcagttctgttcctctaatccagtagtttttaatgtaatcagtcctcatcctaaagcaaaaagctacccttttctcccccatgagttatttcattagggatcttaaatagaagactattccttcagaagattttaggagctttgtgccaggaagctgggagaaagatttttttgttgttgttacactacacacagccatatgctgagcttggtgcaaggcacgggggatacagtggttaatggagcagacacagtccttgtcctcatgaaacttcaagttaggcaaactcattgaaatgaagatcagtctagagaagttagtaaaactgaaacaaagataaataaaacatgaacttgattcacagaaacacttacctccatatatgaataacatcaattagtaaactgggaggaggaaggaggtgctgggtgtggaatggacgggaaaaatggagaagtcaacactgaatttctaatcacctaaatcactttaagtctcatctttttgacatggtgatggtcaaagattggcacattattcttatcaaagcacaggatagggtgctaggtggaggaaccaggaaagattagtcagagaagatgccttgaaattctatgttagattgtcatctaggttatacagctcatggacaaaaatacatgcataaaatgatgcccacatggattaatggatacatgaaattttaaattcctagacaaacatataaatcaatgaattattaagtttatactagttgtatatgggactatttgatattgcttactttgttctttgaattttgcatttaggagatttgtagtatgagtttcttgcagaaatcttaacatttccttaaaaaaccacttccctaaaataatccttgaggaaacatatttgtcagaaatgttcacatcatattccttttgttctggtttatctcatcctccttgacttctccacatctctaagtaggaagttatttattgctgctgaagttgtaaccctggtgatttcgctatcaacttacaaatcacttcctttccatatgactacagcatgtaagaatgctgaggttttcttttctccaaataaggcagaatgcttcaagaatattttatcgtcctatatggatattctatacctttagagtgaacactttcctctattaaaacattaacagtcataatgagattcagtccaactggaccgagcttgtgaataaaacaagatgctccagtctgtggttcaaacattttgaacttcccagaatataattaggtatagaatatagttcttatctttctttgagaactttttgaattattgttatagtttctaaaatatcttttctattttgagggtaaggtcacaaaacagaaaaaaatgtgtatcagagtatgttgaatatggctgtttgtcagatcaagtttacgctgtgtatgggccttcgtccaatttagatgcagatggtataagggactttgaatatgctatattattattcagctgacttctccagtaaataatagtgttcttcaggaacagaaaaccaaacgccacatgttctcactcataaatgggagctgaacaatgagaacacatggacacagggaggggaacatcacatacactggggcctgtaggtggaggggagcagggggagggagagcatcaggataaatagctaatgcatgtggggcttaatacctaggtgatgggttgataggtgcagcacatcaccatggcacatgtttacctatgtaacaaacctgcatgtcctgtacatgtatcccagaccccaaaataaaattaaaaaaataataatagtgttctttagcgtctttcatgtgaatggaagttttgcagacattgtcacagcagcattttttcccgtgggtttccactaagtggtgccttcgccttgggggaaaggtgtctcagtcttattccagtctgcttcatttactgttgatgtgatgattgctgcctatgtagtatgtgactttctagggacaggcggtcaggtttttctggacccctctttctctgaggatctcttcaaaggaatagcctttggccttgagtgctgcctcgagcccacaagcaccttctcatggttgagcacaccctattgcttgactcagtgaaatacattgaatatcctgccaacactttttgttgtacatctctttgccctcaggctagctacagaaagaaaaagagagagagaatacatttttacatttcctgttcttcatgttgaatgaggcagtttatcttctgaacagctgctttgaaggtttgagtatgttcgatgcactaaacataacagcatagaaatgaaaaaaggaggttggcaaactaccttcttatcttcttttaaggcttttgaaggatttaagttgtttcaccttttagtggcatcacagagaggttgagatttcacttagagagaatggctttgatgtgctattttgtatattagtgaacaggttcacaaagatgccattctctaatcaatgctcctgctcccacaagacagaagagaattgaggaattaaggaaatgccaagaggtagaacatccagtatctttggtggagatcttgctttgctatgtttccttccttcaagttatttgatctgtgcgtgtgcctgagcatttattgtacaacagatactgtgctaaggcttttataagctttgtattgcttaatgttcatggcagccttgggaagaaggtactgttagagtaggaatgctactataatcttccaactgggttgacattaattccttaacctgctctttttgacttttcttcttcaacccattgataatctaattgtcctatatttctgtaaggttattctaaggtattttttgagattccttattaagaccattaatacggctgggcatggtggctcatgcctataatcccagcactttgggaggctgaggcgggtggatcacctgaggccaggagttcgagaccagcctgaccaatatggtgaaacaccatctctaccaaatacaaaaaattagcagggcgtggtggcacacgcctataatcccagctacttgggaggctgaggcaggagaatcacttgaaccctggaggtggaggttgcagtgagccgagatcgtgccattgcactccagcctgggcactctgtctcaaaaaacaaacaaacaaaaaaactttaatacgtgtgagtatagtagtgaacaattattatgggcttagtaagtgccaggttttatcttaagtagtttatgtgcaaacccgataacacccaaacaaccatgtaaaatagatatcataagccctattgtattttaaatgaagaagagatgataagagacatccctaagctcccactgacataaaatacagacaccaggatttgaactgggcccatcttactacagagcctcaggatttaacccccactcttccagttttcttcatggcctattgtcagagtagaaacattatttctattctgaacatgggctgtgctcaataaattattgcttcatctccttgatgataacaaaccattgcctttcttaaaagtcttttctaaaaaattttagcctagtaatttcaaaaaaaagtaaagcagtaaaatacgtcatcctgtaaagtctaaagatttgaaatttaaaagttttcaggctagagaacagaacttgatgtaatttctagaagtgaaataactcttgttaaaatcagatgctgctggtacgcaatccaaaagggattgtttagaccctagaagcttcaaataaattgagtctcagaaataggggggaattgagtcacacagttctgattgtttttgtcaacctactgaagaggaacaggagcacccttccgaaagagttcagagctgagtgtgagtattcacaagcaagaacctctggcacatcttcatctttataattccaatagcaatggcaaacaagaagactcaatgtttaacttcagatttcattagacggagagccgtgtttacaatcagctgactcatttgagcgttctgacaagctctcaatcctatctggatctgttaggttgtcttttaaaagaggaaatatttcaacagagataatattcctataagctgtgaaagtctgtctagaaatcaattgttaagcaacctatagagtttagagcagaaaaagctacaaaatgaagtaaatttttatagtggtttctagtgagaaacaatgtatgccctaggtgcagtgggccatggagaacatttattacattcttcttgtatgaacactgatatacgaagaaaataaaagctcagcttttgccttataacactacacttgccatggtacacttcaaaattcacacatgcatagggagattatttacacatgtgcaaaactaggaaaataaaataatgtgaaaacatactagttaaatgtgattgtgcagctcttttacttctattctggattggtgtttttgccaaaccctccctatgtcaacacaggtgacccctctgaaaggaacgtgccaattatagttgacaaaggggcttggtgcactgaatcttgagaaatgatcttgaatgacctccaggatttaaatatagttattgaaaggggccgaaccaatgagatgattcacagcttccgcatggagccatctctatatgctaagtacgaggccagtcctcataaaaacccgccaaggagggcagtagcaccattgttaccagcacagactcctccctttcctagctgtgtgaccttaaggagaaatatacactccagaaatctgctgcttcttctctgaaaagggcacaacaatagtcgcccattgtagagaggattaatgggataattatattatgtaaaactcactgaagtattttgtttacatagggactattcaataaacataaaaattataattattacagttgttataattccccttttacagctgaggaaactcccaagaccacagaataagtggaaaagttgaaattggaacctacctctttttgactccaaatgaagtgttctttttaataggtacagtagttcccacctattcatgagagataccttccaagacccccagtggaagcctgaaaccacagccagcaccaaaccctatatacactgtgtttttcctacatatacctatgataaagtttaatttataaattaggcagagtaagagttcaacaacagtaattaaaaaaatagaacaactgtaaaaataatcctgtaatgaaagttatgtgaatgtggtctttctctcttatatatttctggaatattccatttaatatttttggactgaaactgtggaaagcaaaacagtgaataaatactgtaattagtgttcattgataacataattttggccaagtgcagtggctcacacctgtaatgccagcactttgagaggccaaggtaggttcatcacttgagcccaagagttcaagaccagcctgggcaacatggtgaaaccttgtctctaaaaataaaataaaatacaaaattatatatatatatataatgtatatttatatataatatatatttatatataatatatatatttattatatatataattatatattatgtaatatatataaaatatatattatatattatataattatatataatataaaatatatattatatattatatatatattatatatattatatatataaaatatattatatattatatatttatatatattatatattatatataatttatataaatatataatatattatatatataatatatatataatatataatatatttatatatatatataatatatataatatatatataatatataatatatttatatatatatataatatatataatatatatataatatataatatatttttatatatatatataatatatatatgccaaatgtggtgatgcactcctgtagtctcagctactctggaggctgaagtgggaggatctcttgagcccaggaggttgaggcttcagtgagtcgtgattgtgccactgcactccggcctaagtgttggagtgagaccctcaaaaaaaaaaaaaaagtttttttcagaattccgactatatgccaagcactctgttgggtgctgatcaacaaggtagactaagtctttccttatggagcccacattccagctgcctctgacaatgcttttccccatggcactcagaatcctgattcctgagtcctacagaacattctgtaacttggtaattctgaggctgccttggggaacaagcgtaaggaggagggtttcctcagagcagaaaggagggaatgtttttcctgcaattagagagtgcagtgacagtggcaaccacagtagcctcatagagcaccagggatgacagggaagaaagtgaatgctgacctcggctgaaacagcgctggcagcttcagcagatatattacatggtacttaccattacttcatacagtgttgagagttttggctcttgagcagaatttctgggtctgtattttacctatgctgctcatgcattttatgatcctatgtgggttatttaagctttttgtgcctcatctataagattgagaccattatgatattgatttcataggtactttgcaggcaggattacctatctgagagaaacttgatttatttctttgatgcatgcaaacttaagcttgccaatgctcatatttgtgcatttttccccacacaggacagtgcagtcgttaaggcaccatggttagtgtcatctctacatgcctcagcctatctcaaggtctcctttggacagtttgcaaatgagtgcctgcctgagtctctatatctgagggagtcctctgcctgggggagcttatctgcccatgctcaagacatgagggctagaatttgtagataaatacaacagcttccttgtcccttggagatgattctcagacatattccacaatctctcagaggctccctggtggtaccaaatcccagttgtccacagcaatagtggggttgttaaccagctttcctcccttctctgtctcactgccccacttcctcaatttgctctctgggatcttcccccaaataaatgacatgctcccaaatccttgtctcaaggtcttgttttaggaggaaccccaggcaaaggtagttacagattttagagcaggacttcctcctgcaaattctgacttcattacttacagggattttttttttaatactttaagttttagggtacatgtgcacaatgtgcaggtttgttacatatgtatacatgtgccatgttggtgtgccgcacccagtaactcgtcatttaacattaggtatatctcctaattctatccctcccccttactcccaccccacaacaggccctggtgtgtgatgttccccttcctgtgtccatgtgttctcattgttcaattccaacctgtgagtgagaacatgcggtgtttggttttttgtccttgcgatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttatagtagcatgatttataatcctttgggtatatacccagtaatgggattgctgggtcaaatggtatttttagttctagattgaggaattgccacactgtcttccacaatggttgaactagtttacactcccaccaacagtgtaaaagcattcctatctctccacatcctctccagcatctgttatttcctgaatttttaatgatctccattctaactggtatgagatggtatctcactgtggtcttgatttgcatttctctgatgcccagtgatgacgagcattttttcatgtgttttttggctgcataaatgtcttcttttgagaagtgtctgttcatatccttcgcccactttttgaagtggttgtttgattttttcttgtaaatttgtttaagttctttgtagattctggatattagccctttatttaatttttattttgagttcaggggtacatgtgcatgttttttatatagataaacttatgtcatggaggtttgttatacagattatttcatcacccaataattaagcctagtacccattagttatttttcctgatcctcttcctcctcccaccctctaccctccaaaaggccccagtgtgtgttgttcccctctatttattcatatgttcacataatttagctcccacttataagtgagaacatgcagtattcagttttctgttcctgcattagtttgctaaggataatggcctctagctccatccatgatcctgtaaaggacacgatctcattcttttttatggctgcatagtattccatggtgcatatgctttatcaagtctatcgttaatgggcatttgggttgattccatgactttgctatcgtacagtgcttcagtgaacatacacatgcatgtgtctttataataggatgatttatattcctttgggtatatatccagtaatgggattgctagatcaaatggtattcagacaagcaaatgctaaggaaatttgttaccacaagaccttccttataagggaagcattaaatatggagagaaaagaccattatttacagtttttaaattaaggaaatgattaaacacttcattatttcaattttctcatgtctaaggaaggtatgatgataaaagctacatgatattttttgtgaagcttagctgaaacagtacctgtcaagtgcttctagaccattgcaagttttcaataaatgttagcttttattattattattattaatgtcagcctaccttaaaacttctttaaatagatggcatgaacagctgtagataactgcagggtgtaaaaattctggcagctttttttatacctgtttaaactctttgagcttaacgctcttcaagttccctgctggcctgtaagtaatagaccaatgtcagtggaggagacatgtagatgttaagaatgaactaagtttgtaaggtaaaaagccaggcttcctatatgcctcagcagatggtctgataaggacgctgagagagagtatcatgaaatagaagtgaagtggattaacaagaaaatccatgttcctggcacactaaggtgataagtaaatggttttctgtggctttgctaaaattttgaaaaattcagttagcagcaccgttgcctaaacatagtatggtatgttaagaaggaggattctaacaagcacttgttaagtgcctattgtaattaagacaaatatgatttggtttgtgctctcaagtctggtgggagagataggcatgtaaacagatgaattacagcacgaagtgctactgctgcaccaagacaggcaaataattcacttaagctaaggcagggaagaaagaaggaaggggatttttatatacttttatctgcgctgaaggtggctttacagatgaggaacccgaaactcaaagaatgtatgtcaattcattaaggcatgcagctgctaagtggggagccagcatttgaatcaaactttctttccccaaggttgtctccatcatgccaggctgtagtggtgacaggtggaaaggtgtagtgagccatcttctaggtatatctatccctgagagcaacaaatcctggtggttctctctgtatatagtcacagagctccagggcatgtagtacttagaattttgtttttgctcattgcacaggaaatggtatgaaactgaggtaattcatacacacataatttgaatataaagaagaaaatgatagaggcatctggatgacctgatatttaatatagtaaaaggaaaatgttttcctaagcaaaatgagtggtatacaatgaataagttgtggtcaggaaccatgtccccagagttttggcttttatcctttcattgattcacaacatgaatttttttttcctaaatatccttcactagaaggcagaattaatcaacctttgtaatttaacagattatttggatacaaaactaatgatatttttattcaaacatgtcaagaccttggggatatagcatgggatttggggagcaggttggttgttgggggcagtcgtctaaagaatcagtaacatttgagtgcctaaaatattaattattgtcctaccagcaatactgttctctgtccttaatgatgaattaagagattagaaaatagtaaaaaaataaaaacaaggacataatttccatgcgataatgataggactttgtgatatcacatttaaaaagtaggtgacttttatgagagaggaagtgaggaaaagaagccagcatttattgaatgcttgctgcaggcttctgtgccatgggtattaatagtcccattttacagatgaggaccctgagaatcatatatttagtgtcaaatgctttacctaaaagggcaaaagtataactagaacaaaagttcaatgcttaactctgaaaaaatctgttctctttgctacagaccatgccatcttggtgaaaatatcccaaaagatctggggttgagttacagtgccaaaggggagaggaatgtaatattgcaattagatgatgagagattgtcttaggaacactgaagtacactggcaaattttgggaagcagagataaattatgttgctaaaagccaaggaaggctgggcgcggtggctcacacctgtaatcccattactttgagaggccgaggcaggtggatcacctgagatcaggagttcgagaccagtccggccaacgtggcaaaaccctgtctctactacaaaattagctgggcatggtggcaggcacccataatcccagctactcaggaggctgaggcaggagaatctcttgaacccgggagatggaggttgcagtaagccaagattgcgccattgcactccagcctgggagacagagcaagactccatctctaaattaattaattaattaattaatttttttaaaaagccaaggaaatcatttggctagagagtgtgagcttgagaattggatagaagtaggggaagttaggctctgtggcactgggtggtggaaagtctgcagtcagcactttgatcaggtcaaacccagtaatatttttgaactcttatttttctctgtcaggtgccagcaagcaaaactgagtaaggaaataatagtttatggccttatattttagttagtttgagtacctgttgacaggtggtccaatttttgtgtttaatttagaagaaattctgaaggatgaggtttaataatcacaattgaagtagtggatatgggatcagagtctgattgcattggatacaatattccaagatcactgaatgatacaactcctgcaaaaaggatgctatgacaatataagcataaagccgcagggaagtggacagaggtcttaagggttggaaaaaggagtgggcacatttgtgaaatgtagcagagctatgggatttggactttgcaatgtacttgtacagtaggactaaagcagacaagcatagaatgcatgccattaattcttagccttgaggcataccttctcaataattaggagaatgaaaagaggtgttttttatatatccttccacctttatatatattttttattgttcaatgaagtagaaccctgtataaagaggagttcagggaatctattaaaaatccagggtaccttctatgtcctagtcagagttcttggagttgttgaattataaaaatatgacatcccaacacacactgtagggatcaaaacctaggtgtgtggcaggaagatagctcataggcaattccaatatttgcagttgaaatttggcatgaaacactgacaatttgcatcgtctgtccatccttcatgagctgatgatgcccaatgcttgtctcacatggcaggtctcacttcgtactgaaatgatgaagttacttctctgcctccaacactagattgtgtgttgcctgagggcaggagcaatgtcatcctttttgactttctggcacttaaaacagaatgtggctcatagttggaggtcagtacatatttgaatggaagaatgcatgaaaatataaacgttagactcttcccttatggttattgttttagtttataaagtagatgtaaatatagcccaagataacatagcaatttggcaattctccatgaattttctgtaatagaatatttcagtaagcacagtatacttcctgttttaactttgtggctaactgatctttagttatttgacagatatttttctggcaggcaatgcgctaaacattgggggttctctgcaactgttttttattttaagtggtaaagttgctcttttaattcaaatttgttttttaattgacttataaacttgtatgtatttatagtgtacaacatgatgcttcgaagtgtcaataatcaaatggttaaatctagctaatttaatcataatttaaatagctagatctaaccattttgttattgacacttcaaaacacacaaacacacataatgaaatggtcaaatctagctaattaacaaatacattacctcacatagttatcatctttatggtgagaacatttcacatccactctctgagcatttttgaaaaatacagtatatcatcattaactatagtctctagactgtataatagatctcttgaaattatttctcctaactaactgaaaatatgtatgccttggaccaacatctccccactccccacccccaaccaccccagcttctggtacccacccatcttcagctgtttgtaaatacctacggttgatgaggaaatgcatttgttgaaatatactgaagcctgtggattattgtaataatccttttatgctatcaaagatttactgctctttgagcttaccttagttgggtcttgtaaattgagtgttatttgagaacagaacacaggagggcaccagaggacaagaaaacgacaaccaaaaaaaaaaaaaaaaaaaccccaaaaccaaagcactgaacttctggctctagaatagagaccctgctaaatgtatcatctctcagcagtccatttctattaagtcttattctttaaaggccatgaggtatttgtaaacacgagagctttccaaactttcattaaaggaaagtgtccctttcccagacaatgcttccagctcagtcagatgcccaagcatgaccagaaggagacatggatgaagagaacccagggggtgtctttgcacacatgatgctctaaagcattttcagatctcctctatgggcccagcaagagtgctgtttctgaggaagaaggcagattgctggacggattcacaaaccacggcagctccaactctcctaccgatgcctttactccaggtgcctcagccagtagcaacaggtctccctgttggtgatacccaagggcaccatttaagaagaaataaaaaatgatgagttcatgtcctttgtagggacatggatgaagctagaaaccatcattctcagcaaactatcacaaggagaaaaaaccaaacactgcatgttctcactcataggtgggaattgaacagtgagaacacatggacacaggaaggggaacatcacacactgggcactgttgtggggtggggggagtggggagggatagcattaggagatatacctaatgctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctaggcatatgggagaggttgagtcagtcactgtggcttagaggctgcagtgccttatcaatttctggcattgaattatgactagaatttgaaaaacatcaaacatggcttccatgacatcatagtctcagctcagtatgtcactgagaggttgtagtagtttgcagatgacagtgatcaatgaaaacccaatttatttgactcaaagggctgtggatatatgtacgtgaaaatgtattctacagccctaacctgctgcatctggctctggaattccaggtccacatttctgagtatctgctagtcatttccatgtatagagccatcccttggtatctccaggggactggttccagaacttcaaaggaactcaaatttgaggatgctcaaatccctgacaaaatggcatagtatttgcatgtaacctatgcccaccctctcacatactgtaaaatcatctctagattacttgtaataaataatacaatgaaaatgctatgtacacagttgttactgtttcgagaatattgacaaggaaaaagttctgcgtgtgtttagtacagaggcaaggttttgagaatattttaaatccagagctggtcgaatccacagatgtggacccctcagatatgaaggatcatctgtttatcccaccatctcatactcaggatgtttaaaatagagctaatagctgtttctttctcaaacccagctcttcttttctttgtttcatctaaattaagtagcaagaccaagttttccaggctggaaaagtgtaagtgatcctcaactttgtccccccaccttccattcctatcattcagggggtcacctcaaccatctcttctatttatacctttcattcatttcactctgctatagagcattttgaattcaggatttatttacctcctttctaagtaagttgaatggcctttctgtgctttttctgttctggtcttcacgtaatccgcttcacattctttttaaattcacctttcccaagattcatcattgcttacaggacaatgtccaattccttagcattacatgcagtccatctatctttcctaccttagctctcacttcacagctcataatccctctcctccccaatgtacacaaacacacccacctttccactgtggttcatcttctggctattggttatattttgccttcaattacctctgctggatatggaatagcatagaagttatgcacatgggccctagaactaaactaggggtctgcaaactacaatcagcaggacaaatattccccaccacctcttttcataaataaccatttattggaactcaccaaggaactatggagaaacaaggaagaatttcactataaaagacgccagaggaaaaaagagtacatattgtatggttacatttatataaatctaaaaaatgcaaactaatctctagtgacagaaaacagaaccctggctgctagaggagcagggagaggaagggagtacaaagagccatgagaaaacttttgaggataatgtatatgttgcttatcttgattgtgttgatgttttaatgggtctactcatatatcaaaacttataaaattgtacaccttaaatatgtgcagtgtatcatgtgtccattatacttcaatttaaaagaaaacatggaaaacattcagcatccagtgtccccatagcctcagccacagttagcccgaagagttgcttgtgtcttgatagagagaccactgaagtaatttccacagttcagggttatcattccattgctagttctaagaatcttacccttttcatgcctttggtctctcatcaaagatgtaggatggctggacttactaatcttcaaggcacttttcaaatttctagagtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaacattgttataagccagaaacagagaaaacagttaacatttagacaagtgattattactggcatccaggtaggctgttggaataaccaggatatgagttgctaatcgttcatttattaatcttcatggaattaaatacagaaaggatgaatacagaggagatcctgtgctggacacattctctgtgttagttcatttattcgtcaccatatccccttgattaaagtgatgatgagtctttccattttgtaacttggagagactgaggctgagagatgtttagatgtttgtccaaggtcacacagctagtacctgctggagcagaaatttgaagccatgtctggctcattcaaaatcctatgttctttctcacaccctgctggctcactacttattgtgaggcatttgaatgatcattcagctatttcctttacctgatgtttttagtttgctggcttcagtttcttagaggcaccctattgggccacatgagagattatagaattatgttgtgatcatggtgggctattatctctgcaaactctcctgacaccatcagtgcaccaggaaggttggataatcctacgtggatgtggagaaatctcaacctttttttatttgacattaggatttttttttccctctaggtggtgttttcactgactttgtggattgcaaaaagttgagtttattttagtttaacagtcaagaatgtggttctttaggacattttctctttagtgtgcctggagcttctaaatcttatttaaaccttctttttgaaatagatgttgcatatctttggctgtaagaggaagtcaggacttgttctctctgcttccagacccactccccagccatgtagactttatatttgaaggtccagagtgatttttcttttttttttttttttgagatggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagagtgatttttctaaggcaataatctgaccctgtcattcccagcagcatgtagaaaatcaccttgacactccaggtacattcaagtgggctgccccagaggtcatggaacaaaaagcctcctagaccaagctaagatgtgaaattataaattgtttattaaatcaatttaaggtacactttaagcataaatcaaggggaaagtgattggttcaataaacacaggagagtgtgcaagtgggatagaaagactaccatatctcaatccttggttacacaatgttcatctaccttggttccctctctgccatattagtcttccctgctgatgaagtagttacaagaaccagagttgagattaagaaagggatacaacagctgggaaacactggtcctgttacaccattgccctcctggggagacacaagggcaagtatatctggccatagctatcacttgccaattagcctggtgactagatatatgttttatctctatgtatcaaccagagcaaatgtggggccagaatgggaccaaaatggatgtcaccaatgggttgaccagtttagggatgaaggagtcaacagagattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagccactagtcaatgtccagtgtgttataaataagcagtaaatatttgatgagttgttgagttaatgagtaataacaaataaatgttattgtacaacaagttggcagatatttgttccttgaatagaatgatttttataattgtcatttacaaattcagtttagatgggatatttttctcttatttcttcccttgaacgttttcccccaactaccgtgtactcccattactagatttttttataaatcacttaaatatgtttttgtaaattattaatagcagcaagtagtgctgatctgttgggcacctaatgtgtatcaagctgtgaattagaacttgtcttccactggtcccaagagagctggatcagttcacaaccctgcataaatggtagctaggattatgattcagtaggagcatatgtagcctcaagcaggataattagttgtaataagcacataaccacattttctccctgtttctgtgttaggggatggcagtcaattcacactttgaatttcaatgtccataagctgcatttaaatacattcatataaatgcatgtcaagtaactaccatgtctaggccttggactagattctgaaaaaaataggcacaatcactggcctcgtggagttcatagccagcatcaccttaaaatcaatgagaagtagaaagtcaggttattgagaccaggatgatctacgctgcatctaactgggggatattaagttctcacagacattacaagcttatcccagtcaatataagctcactgtataatcaactacctccatatacaaatgtcccctcctccagtggcatgatctagggctggcagggattcacctttccttacccgtggtgcttctcaaaattcccctgctgcctcacccagccacccccattctcacccagtctaagtatcagttccaagaagcatttctagttcctctacccctttgttttccgcaaaccttcacatctgctccctcagaagcaccattggttatggaggtctgatctgaagttctacccatcactcacacattcatcatccatccagaaggcagttttatataaacccagataagcttggctttgcatctacttagtagctatttacccttggctgagataacttaacatccctgtttcttactgctgtcatctgtaaaatgggataaaaatgcttacttcccagtattctggggattaaatattaagctccagtacaaagtgtaacaatgactttatgcgtcattatccccgctggtctcccatagctgttctctagcacccctgtgccatctttgggattgtcgagttagccctgaagtggcaaggaccctatttcagtgctcatatttaaaaagcaccaccatcagcaaaaggggtgtagagaggaggcaccatttagaatcttggaaaatctgaaaaaacttgcttctaggccagagagtagagagaactgtgagattgtgtgctagccacagtagaccaatgttggattggagatgataggtcgtcttaatggaaagtgtgatggggagccaatgtggcacagtagctcagagtgtgggctctggagccaacataagaagagttaccctaacagaatatagaccacagagttcttcccttcaagtatggattcatcatacatccttcaaacctgccaagtacttcactttctttctctctaccaacctgcttcttaccaaccttctaaagtcctgttcttgattcaccctaggctcacctataaccttcagaagccctgtctctgactcttaactcttcctgtcttaacactgagcctctactttcagctttgggagccacaatgagtgtttcagagctgaagaatatctggagcccatatgtcagacatgaaagatttggaaaaacagaaataaaaaagttccttgaagtatttgaaatgatttattcaagtagggttgggacctaaaaatttgccaaatatatcataatgggggagtagtaccaggaacgtagagaaaggaagagaaaaattgatctcatagaaataaaacgtagaacagaggatactagaggctgaaaacaggagggggaaaatgggagacacagagagatttgataaaagacacaaaattacagctagatagaaaaaataagtgctagtgttccagagagctgcaggatacaacaatatacagtttcaaacagctagaaggagcatactacatattaaatgttccccaaacaactaatgataaatatttgagatgatggatatgctaatcaccctgatctgatcaatatatattatatgtatcaaaacatcactatgtaccctgtaaaaatgtacaattatttttcagttaaaaaaggaaaagaaacaaaaaaataaatattctgagaagatgaccttaagagagatgttggaagagagggagggttgggaaaatgggagatgtctgagaaataccctagaggaaatttgaaatagaaaaacagagctgaggaaagaaataaagatgaatcaaaaattaaattggagttatatgatggttcagggagcaacacatgtgtagagaaggaaatgagaggctggaactttggggaatcccagagttaagtaatagacaggggaagaggcagggaggggaggttgctcatgaaagttcatacatgtgggaaaaccatggacagccatgtcactgaagatgggagtggctgctgaagcctaatggtgatgaagaagactagaaaatgttccttatgcttggcgatttgcagattattagtaaccagatagaacagcagagaaaataactagctgccaaaaggttggtggggagggcttggagggcagaggaacctgggctcagcagcagtcaagggggattctgtgaagtctggggggagaagcaccctggtgggacactctaaaatgtcaaggtgaatggagaaagcaagggaaagaggcagggttatgaggagggcttctgtgagtggagtgaaatttaaggtgcctaaagaaagctaacaggaaaagtctgaaggttgagaaaagaagcaagatcactgttaaaaaaaaaaaatatatatatatatatatatatatatatatatatatatatatatatatatatatatatctcaaagaatctagaaaaaggataggaagtggagtcagaggagagtttagtcttggacaaggtggcagggtccttactctaataacagaagcaaaactgtggattaagcttataaggaagggatttcatttatttactcaacaagcatctgagtgtgtagatgcagacatgggcattttagacctggttttcaaggtgcctccaatctggttggggatatggataactgaagaattagtttgcaacagcatgagataaaccatgagggatgctgactggggtgttgaagggtgagaggatggcaggtggtgagagagacattccagagtttccttgtgagttacaggtttggttaggagggaagtggagctaactgttgaagaatagagattggccaaatctctggaatttcagaagcatcaactttgggaaacggaatttgctaatggagtggagtctgatgcagttcttcacttattttcttctggtatgcagaccaaaattatctgagaatgatcttttcacttctggctacaaaaatgcaagccaccagtagaaccacaggcaccagtttacagtgtagagagcactggactgggagtcagatctgggttgtacttatgtggtcatgggaaattccttcccctaggtgcagggactcaggattcgctttagtaaaatgaagggttattctttattgttctcagaaaggtggtttgagaatcacctgtgtggtgggctaagtattgtttcctaaaaatttgatgtctacccggaacctcagcattgtgacctgatttgtaaatagtgtctttgcacatgcaattagttaagatgaggtcacactggattatggtgctccctgattcctatgatggtgtcctcatcagaagagggtacacagagatgaagcccatgtgaagacaaacagagagtgaagtgatgcttctgtaagccaaggaatatcaaggattgcaggaaacccccagaaactaggaagggacaaaaatgattctcccctggagcctttatgacctgctcacaacttgattttagacttctcaccagaactgaaagataacatattttcgttgaaagctactaagtttgtgataatttgctacagcatccctaggaaagtaataccacctgcatccggaatatcaggaatcttattaaaatgccacttcatagtatccatcccagatcttctgaatcagaaatactgagactagagccctgagatttaaactattaacattatttatgtttcttatgaagttttaaatgtgagaaccactggcctaaatgatgccttaacagctctgaacaatctgaaagttaaaatgacaggactattttatgcatatagacgacatctcccccggtgaagtgtgttacttcccatcctataggtatcacaaacagaagtatttattttattaaatacaaaaagaaccagatcgcttccaaactacatgcttctaaacactttcataggttttgtgttctggcagcattttaaagataaaactattaagggttttattttttctggagaggtatttgtctctgagcagtttgatgaatatttaaatttcttttaatctgtgttctcccatcattttctgtatatgtttctttcttatctcattttatctggccttattttttttctctgcttttattcattttctgtgtactcagaaattaaaggcatatccattgtatgtttttatttaatagttttttactctttatcctgtacggcctgtggaaaatatttcactatgaggattagtcattgcatctctgaaccatccctgatgcatctcttggctaatggaggctgtatagtgtagtagttaaggacaaaatggaacgaggctacccaggtttagttccagcaattaggttatgcaacattgggcaattgactgaacttctttctgtgtcagttttctcaagggtaaaatgtggttgttaatgggacccatgtgttagtccgctctgctcagttatgctgcagtaacagatgcctccctggaatcctagtgacttaaatgagcagagctttatttcccaccggcattaatattcatcctagttctgctgcagtgcttcttcatgcctcttcatttctggaccctgcctgaagaggcagctctgatttgtcgcatcctggatttgtggccaagggaagagagctagcagagccatgtggtggccctcagaccttctaagtggttcacactatttctgctcacattttcttggctgtgaagcacataaggcaaaatgcctgacataagaggcagaaaatgtaaccctccagaaagggtggacctattcggaagaggctggtaggaaaagacagcaaatattgtcaaaaataatgtaatcaaccacagcaactttatgggattgacgtgagtattaagtaagttaacataggtaaagcacttagaatagtgtcttatgactattgtctggtggtctattattaacggggtcttgtgcaagtatgtgaagacattaattctttatttgagaatccaatgtaccttccaaggaaagtgctatttagagttgagaaagatacagaaatacaggtcttggtctatgccttatggaatctgtatactcctccatgaagaatgtgaagaggaacagacagttgatgacttccagatggcctgagtgcccaccagcagggtatctagtggacacctctgtacctgttcttccacatgattggtgtttatttgttcaactcccccagcagactctaagctcctttagaacagtgagtgtatctttttcatcttcgcaccccagaaactttcacaacacctgtctagtaggtcatcaacttttaaattaaacccctccttctttatacagtctgaaagtggggtggtaatttcactctcttaggtaagaacagttttcttctgcttgatgccccatgttaatgaggaactcagggtgcatggaggaggcagtcagcagtttgaagtttacatccatactgtgcccaaactgttgcacagaagtatgaagacagcgcatggaaattagtcctgtttgccaacatagtcggttttgcatgcgtcatacatggccaggcttgctgtattaagagccagctgcatttaagtcttacttaaggggaaacaaatacatttgaattgaaatacacttgatttatttttgttgatgttctagttttaattattttctctatgtgcatgtcttgcaagttttatttttgtggggactataaggatatgatatttccagggagacgaagagctataatttctcaacttttcaaacctacatacatattattttaggaaggacaaatctcatcatcttagttaacaagaaccagaatagagtgatagttctgctaatctggcctcctgggtcttgcagttgcatacaccagatgctaagaggataagacagattagccaggagtaagaccattctgtgtggcagctacctctgtccacagtgggtgatcagctaatgccatcaagctcataagctgataggccttgtaattaccatgccaaagaggctgcaaatatccctcttttcccaattttaccttatatttagtactttctattgtaggaaggagatgctgcaaacaccatggaggttgatctgaaaataccgtattcccagaactctttgtcttgggatacttctaaaatccaatgactgtatcttcatatctatacataaagtcccccatccagatgggatattcatccagaatatggcagatagaacctgaagggtctttgggtatcaagagcatatcacttagcttcttacttgaatagacttacgctatttaagaatgatcgtaacctcattcttggcagtagagtgaattagacaaattaacaaattagagttcccaaaagtcctccatggttcagagtgaagagctatgtgattgtgcttagagacctgtgctacttcctcacaaccccaggagtctggtcagtttttggtaatttacaaccatggtccctcagcctgccctgagtgctgacagcagactactgccttctgtactctgtgggcttcatggactctaggtgggtatttaggttaatgggaagtgatctatctgtggagtcaggacaggcagctatctaggttaatgggaagcaatctatctgtggaatcagaaagactggattctttatttaatttcacaattcaatagcttgtgagcttgtgcaggtcacttaacctcttaatctcatcctaggtaattgacgttacctacctcatgcggttgctgtaacatttgagttactgcatgggacatgattgagtgctatgtaggttttatcttagtttgagttcccttgagagcaaagcctgagacaaagacttgggtgagatagtttttctggagtggtccccaaaagcagaagtgaaggagcagggagagtaagcagtgcagaaagaaacaccagtatgagtgtccactgtcaagattcctgctctaagcactgcataggtgggagagatgaaggtgttgccatgaatgcctcccaggattttctgcttaaaacataggaggttggagtatttattcattggctcccttcccctccccattctttgatatttacccctagggtattcttgccctcactcccatttcttggttgctctttcttgcaggcagggcaggcaccctagctttagagaaggcccaagggctggccatgcttgaagtgggggaccatcaaactgtctgagctcacaataactgtcacctgctgcagtggctgaaatctgacattggctgagggaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactcttcattatcctcctagaattagattttctgtttcataattagcaatagtctcccatatcctccatgccctttacccagcctcaccctagtcctctttcagtcctgagacaggacaactcagggatgtaaacatggagaaactgtgagaacaaaccagagaggaaggatttttcagacaggctgactagggtttgagtcccacagctgtatgaccttgacaggtcacagagctttgctctgtctcttgattcctaaagctggggtatagtagatcagctgcatgctacaaaactaaatgagaccacgtatgcaaagcaactggtacttctttatatatggtactttcattcccctatcacttccccaaaaagctgcattttttctggccaggaagaatatatattaaaaggaaaagtagtgacttcatttatatctatctgctgcctgatatctttcagctccaaatttgtcaaattcactctactgccaagttccttctgctcctcttccttctccccctctaccctccataaatttactctcctttaatttattcatccatttctatgtattcacttattaattcaattatatgtatttactactatatggaatgctttcctgaatcggttcaatctgtcctattgctaaaatacagtctgcagctctcttcagctccccctccatttcttctctccccctcaacccatccactcatttgtttatttaatttattcagttttatttatttgctcactagtttttttccaatacattgaacaccctcttggtgcaatgtgccatgcttagttgttggggattacaaaggtagaatattctacctcaaagggcatagaagtgaatttttttttttaaaaaaaaactacaatacaaggaatagagtggtcatttgcaaaataaaatttttattgaattgctgaagcagtaaactctcagctgggagggtcagggaaggctgaggagggatggctgcagatagaaaggttataaaagtaatagagggagacaaatgtaagctgtattttgcattccttgattcctatttaaagcaaaatattaattaatattaatgtactagacctttaaattcataattggatatatatttttttctgcatgctagggcaaaaaggtcaattcacaagaatacagacttaaattagaaatgtattaggggatggtaggcagcaggtcttatggcatatcctcgttagaatctctttagctcaatcacattcagcttcaaaatctgtgactttagtgataaacagtaagatcacacgatcagactcaaaagcactataatacctaaaaatcattgtaagaaatctaatttgtattaatcataccattagaaaagtggagaaagtttcagtatctgttataaagtttttttaaaaacaagagtagaatcaatatccacaaaaggatcttcctgcctatccctgagaaaattgcccttatctcttgaaaagtggtttcatggagagagattatcgcaagaaagcttgagcctgtccccagcttaccactgctgagcactgctgtaaatttatggcttgaggtagaggtttggcaatacattggggacaatattctttttcatcttctgaggagccatttgtttctttggaggtatatctgctccagattcattccatttcaaaattgagatgctccattctctcagccaagatgaatgggttcattttacactgtgatcacaatttagagatgctattgaatgggctgccagtgtttgctttgtaatgttaggggcactcttttttctagtcttaaggcataggttacagcacataacagaaaccatgcaggaaagacaaaaagaagaaagagagggagggaaggaaggaaggaagaaaaaagaaggaaagaaggaaggaaggaaaaaaggaaggaaggaagggaacgagggaggtgggtgggcaaatagcaacacccaacaatcctgtatcatcaatagatagttgtggcctgaggtataaattaacactattctaagaaaaatcaggcaagcagtgaactttgattcatacgtctcagcagcaggaagctgccgggagctggttatcaagtgtgactcataggagagacacaataccagaagtagccttctctggctagtaggatcaatcatgtcttacttttttctggaatctttcccttttcagtgaggctgttttcatctacccagtttgtcagagcaaaccctaggaatcaacactgatttctctctttacttctcctactaccaattcacctcccaaaccaatctccaagtcctgttgactccacctctaaaatacatcccaaattttacaactttcatttctactgtctcctagttttagcctaaatcattttcatctcttttctttaatagcttcctaatagatcttgtttccattatttcacttttggtctaatatacctacagcaaccagagtgattctcaaaatttaattgagattatataatctccttacttaaaaccttccaagagcttccagtatgtgttgaagagctttcaggtttgtaccatgtcattaggacttcatgtgatctggactctgcctacatcaccagctttgcatgattggctccttcctaaatgcaccttctcagagaagccttctctgatcatctcatttagtatctttctacccaaccaactgctcaggacaagagtagagaagtcacctcaaagaggccttcctggaacattctacaaagtagccagtcctcagtcctcactccctacccccaactgcttttcatcgtattaccctgccttattttagatagggttgacagaactcaaccctatctaaaattatctcatgttccttaatttgtgtattgtctatcagattttctcaccccaaagtagactgtaaaccatgtaaggcaggacccgttctgtcttgtttatctttttatcctccacaatgaggatcagaatgagcatcagaatgtgaccacagtgcctggttgccttctgatgctcaattagcatttgtgaaagatgtgaatagatagtcttgcaaaaccttggcagaagtgagtaacagtattctattaataccctgggaggctgaagtagaggatgaggcacggagaaagaggtgagtagtccatcgttgaacttgttatatgtggcagtctcaatggtatgtttgcttattaaatcctgataaatattggtggcatttttagtaggttttaactagaagcaggggctcctggagggtgctcaggctgaatagctgggtcacttgtctttctcacacctccctgggagacttctctgtagaagacttcaagaaaaatccctgcaccttccacacctgttgtaggaggtatggcagctattcctgagccttaagtactccagtaagaatgaaatgaactatttgaggtgttctgccaaacgggctctaaaaataattatgatttaaaatgttttttttttccagtgaatatgaacgctttaaaactaagtttgtaaaaacaaaacaaaacaaacaaaacacctcctcaatctctgttgggttagacacccaaagaaagcaaccagaagctgaaattttgtggacagaacataaaacgcctttttcctacttctctgtcctcctcttcttccttcagtcctgttctttttccttatcatccctgcttttacttgcctgatctgttttgtctggggaggatgcctaatacaatgtgtgatgctatgggcttagtgaaatgcttgtcacagctcagctagcctagccaaaggggctggtggaagcaaaggtaagttttcttttttgacatatctttggtttccttcaaatctaacacagtccatcattttgagcatttattaaccatatcatttagatgtataattataggcatctttcactacgcctttctaaagagggtaattttcatatattttatgcattgtagaaattttggttcatgtgaaacatagtttgaagggaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagtttttaagaaaactgaaataaattaaaaataattaaaatccaaagttcaccttatgaaggtgtgtgcctttaataatgctcaaatatagatttttaacatacactctgattttctgtctgccaaaagagggaaaaatctgataatagctgagtgtcatcttcctccaagcaatcagcaatgcattatttcctaatattgctgtttgatttcattattggttctggcttcttaaagaaataagggttccatagggttactgtaggataggtcaagaaaaacaatctagtcagtgtatttcatccatgatatcttattccgtattccccattcaacagagaattaggccatcttctgtgaagcaaagccttacctcaaagagatggtgctaaatgagttttcaatgaggatagcttgtgtgagcatttgggtggtattattacccaagggattcattaaaggctctctgttctacaatagtaaacaattaaacactctatttttacaaagttctgcatcccagaaatcttttgcatctttattccaggcatgagtgtcattacctgggaaattcaactgaggagtgttaggtaatttattaacattctctacttagatccagcagtgatagtttaagcagcctcaagagaatcaaaggatttttttttgtgatcaatatttattacttaaactataaaagagggaaaaatacatgtaatacatacaactaatatgtacccagttgcagatcataactttcctagttattaaaaatgcaggaaagttaatggttttgagacgtttcttaagttctcactagtttcattttaaatttcagtgttttcttctttttgtctgaaccatcctttacttacgtgaatcactctttacattcattgcttcactgatgctacttcactgggtttttgcttgaataggccagaaaaagtcatccctagactacatcatcaagaacagttttgtatatttcaaccttcagcttgtgtctgcatcttgcattacttatcaattcacttttatgcctgggctacttattaggtttgtttctcctctctctttgccttgatttcccgctgagtgtaaacatcacttttcctctgtagaatgagttgaccttttgacttgattaaggataaatgccattgactctccacttctggaggccaagggttttacaaaatcccactgggacttatttatttattgtttgaaaatgaatatcaaatactattccatatcattttaatgagatggatgtgaatctttttttttctactttaagaataataagaattgttactgttggaggtatcaaatgtaactaaatagtagggcatgagaagcttcagttttttgggggttttttgagatggagtctcgctctgtcatccaggctggagggcagtggcgcaatctcagctcactgcaacctctgcctccctggttcactccattctcctgcctcagtctcccgagtagctgggactacaggcgcctgccaccatgcccggctagtttttttgtatttttagtagagacggggtttcactgtgttagccaggatagtctcgatctcctgacctcgtgatctgcccgcctcggcctcccaaagttctgggattacaggcgtgagccactgcacctggcctggtttttttttttttttttttttttacatttttattcattggccatcacattccaaagttttacagtcaaatggacagttaaatatttgtgtttgaatctgaccactgtgaatatctcaaggataccataagagctgatggacctccaaacgttagcatcactggactgagagaaagctcgttttatatctctataggtactgtcataccaatgaagcaatgttcccaaactactatgtttgtgttagtcattttccgcttatcttgtccccaatcataaaaattaagcgatgtacaaaaattgcctaaagaacagatgccaccttatagaagatgttttaaatagcccgtacttgtagcagttctgccttcatagctaatattctccacgtctttcttcacttttttctttcttattgaagcatttgcatgtagaataaagaggataaaaacataaaaaaacaaagacagatttgttttttctgagaacatctgttcttgttataaagaatccacatgatgtggtccattttctttcaatgccctcactgttggctgttgtgatggcaactgttacatcaatcttagacctgaacttaataagataatgaagagtagtatctaatcagttgaaaatacagggaaattctgttgtaatacatacattttatgtaatattgagacaaacatacaaagcaagataagctgagatgtaatctaaaatggtttattgtagaattactttattcctaagattcattgctctcatggcatcactacctaattttgagtgcatttggtcctttaggtttccttactaaatgttcaagattcttgtaaatttgggttgcccttgagctttgggtgcattctgaaaattattaaatataagtcatttgctgtgtacattgtaattaaaagaaaatttttcactttgaaactctgtttatttttcaagaggagagttcctccaaacttgaactactaccatagctcttataaccagcagaaaataggaatactaattactcaaaattaaaaggtgtagtttgaaattacctagagatttatattcccctgtataaaatgtcttcagtcttggagaggagggaggagtgtagctagtgacagttacataataaagctttcaaaattacttagataaaatatattgactctaattgatggttaccatagaaacagacttatatagacattgattattcaagcactcattaaagctcctactatgtacttggccctgtgctcagtatatgttggagccaagtatatggttttccaaactatttcacatatatccatagggatatattagccacttatatgttatatcattttatttcctagtcattttcaggaatggggctttccacatatagattgactaatccaaaaatatttaatcagcgtctttcttcatgagctcagctatcctcctacaaagagcaaacttggtctgtcttctgcttctatgtaatcttctttgtcttttaaatttgcatttcagatcaataacgatatacatcctaaaagaatgtgatattttcttcctttattaactggatcattttaatgcctctttgtctctcttgccatctttttcccctaagtacaattcctgttacccctgattctttatagggttcacttgaaccttagcttgagcatctggagcatggatctcttgagacaacttggtttattcctctatttagtggcactttatattagtcatgcttttgtcctgaaaagtttcagttttggaactttacatcatttcagtttttaggtatttggatccttttggaggatgatgaacaatgggaaaattctgggggccctcacattcccttcaggagcattatttatgatggggtttaaaacttgacagtattactattgtaatgcttactattgtgatttctatggtcgtgaatcctagtaggaccctgtgttaatggaaatgtcaagttaaggcatatgtgttgcaaagttcttttctcgtcctattggtggatactctctaaaagccagactggtgtatcatgccaaatggccaaattattctatagaaaaaatactatggtaaatttcctatatcttaaaggaattcgtctggattctaaaactttgagagattaatgactgctaactacagcttcctgtaaatgattgcttactgccattggcatttgaaaaccttatatctaagataaaagaaggcactatttttttcattactgtaccattatcctttatgtttgaattgagacttttgcatttggggactcctacagagaatccactggatcagtaaaattcgaatggactttgggtggaatataattccttgaatgctgctgggtcatgtgcaccagtgtggttttgacaaccctgatgcatgagcactactttcagaattgattctaactttggcacttactaccatccttaggcaaaggaccagagaccttgtatgcagggcagaagctcaatgacaacgagtggcacaccgttcgggtggtgcggagaggaaaaagccttaagttaaccgtggatgatgatgtggctgagggtgagtatgactatggtgaaattcgtctgtcttttctctcagtcctctcagtcactgagtgagcaaacagtgttttgcaaaaccttttattttgcatagtagaagtcacaaatcatgttttctgttgacaaactcaggcaaggctaagaaggtcttcctctgtattttacaataccttttcatcaatgtgcgttatggaaattacctactaactataactacatatttatgggtctctctccttaggcgtagagtatgtgtctggagaacagatgtagggttctacagatccttttattattcaatcattcaaaaatcacatgtcaatcatcctcccatatgccagttccttccatcagtgagtgaatcactctctagtagaagagatgggcaaaccagaaattcagaacattacaggtaaaagtaagtactaaaacagtgcatgatacttagaaggtgctgaataaggtttggtttaattaattacttatttaatcattattaattatctattctgcactacacaccattttacaaggcactgataatacagtggtgaacaaacaagcaaatctttggcctggtgggatttacatttagaatgtggaaagaaacattcagagctccacacaatcaataagtatttcctaagagtctgttctatgtcagcagtatgctagaattgcagaagataaaatggaaacagatgagattacctgtttcctcaaataatgaaccaattaagcagatcagataggactctggtatttgaaaacaggaccaaaatatataatgagattctaattttgatgggtgagattacaatttgtcaatcagaagagagaattacccatttgggctggagaaatcaggagtggtttataaacgtagatcttcagactgaatttgatggtggatgtaatttatgaaggctgaggtacaagaaagagggtatcatcaagtgccattttacatgctatatcttttttttctttctttcttttttttttttttaagacagtcttgctctgtcgcccaggctggagtgcagtggcgcgatcttggctcactgcaagctctgcctcccgggttcacgccattctcctgcctcagcctcccgagtagctgggactacaggtgcctgccaccacgcctggctaattttttgtatttttagtagagatggcgtttcaccgtgttagccaggatggtctccatctcctgacctcctgatccacccgcctcggcctcccaaagtgctgggattacaggcgtgagccatcgcgccaggccttacatgctatatcttataagtcttccctctctgatattctagagcaggacacatctatgaagcagaattcttatccatatgggaaagaagatttggggcagcatggggtattacatgaaacactgttgccatcagatctgggccctgacgttaacttgcaggacgttaggaaagttaacattcctgggccttgtcaaatgcagtcagtggcctaagccatctccatggtttcttctgtgaataagacagtcagtagccctgggggtctaatataatcattgccactaaaatattttatgcctttgagatagatatactaaacctctttttcctaatttcctcatttttaaaattgatattctattatttctatggcctttccagcatgaatattctgtaatttggggtcttataatttaattttatattcatgagcctgagtttctatacttctggaatcaggaaatatagtaagatatgtacgtgcatgtacaggtgtgtgtgtgtagagaaggatagcctgtggattaaggaagagcgtctaggcacatatccagtgcccagtaggcattagaaactgttagctgtgttaagcatatcagctcctttaatcttctatcattcactatagcctttaaaggtaagtgttcttaatgccatttaaaggaagcataaaactttgagagcgttgtataattaagctccaaatccatgtcagtgtgattccacaaaatcattctgcttgctgtacttcaaaatccatcataagaaaataatttatcttacaatatgggaaaaatataatggaatgggttggagtgaggtagggaatgcattagcttattaaagtctcctaagaaacttacaggaggtaggccacaacacttgacctctccctcacaaaaacaaagacaaacagaaccaccacaacaattacccaaaacacttcgattacacatagacataactcagaagcgggaggtgaagttcctggtctacgtgcctggagcataaatttgcattctgaaatgaacattttaaaagagatgtacaaatggttacactatttagcgcccgcagccaacctgaattaattattcaagaactgtatgaactgttggtgcatctggatcctgcaaaggataagtcacacatctgttgctcactcctctgggcttgtctctgaagggtgatgggattcacagccgcttctgaaaagcagccactagatggcgacctcaccctgatctctcctgacagtgagttcgtttcattttccctggaaaataaatgctccaaaagtatagtcataaagaactacagagctgagggtactataatgtgtctctctcagtcattattcttttatgaaaactttggaataaagctatttgtaaattgcactttcttttaccactaataattaaaaagcagggccaagtcacgaaatgccattatccagtaatttgattttttgaaattaatgaaacgctttcattttcagacgtgtccccccaaccccccgaacttcactgctgatggaagaaagcagccagaaggataaagaaatttgagaggggaaaagtgctgttttgcttatgagttacaatcttgggttgctttttatagtgataaggggttgggaaattttaattttagttcacagaagtcataaaatcaggcaatgaaactaaaatacccacagtcctcaagttattaagtagtatctcattggcttatttagtaatccctttaatgttctttaaggcccccctagtgtgtccaatttcagctagtttatagaaatgatgtaaagaataggtctggctcacaagaaatcaaaagcaaggatagaaatattcctcaaccttgtgtttatcatttattgtaatgtgattgtgttcttggaaaagcattaagttcgggtgacagttaataataattgattgatctatgtttctattattaagaatacattactataccaagcataacttgagttatactcctcagaattggggcctaatgctgcatgaactgcctcctctgcctagaacttcttgctagtacaaaaacttgcccttgctagtagaaaaatttgactacactggttcttgttgacttttcctgtccttacctacatagcatgtatagcaccaagctgtaaaaagtcattttgcaaaattttccatttaaaatgtatttctcatagtaatttttaaaaacttgacaaaataggattgaggagtgtgcggtcaaacaaaatgaaatggagttctttattgccaggcttattaggagactttaataagctaatgtacattgcaaatcattgataagtatgcagtatttgctaattttttttttttttttttggttccagaaactttttttactgaagtattttataccacatacttacacacttttaaaaaatgctgacattatggagaaaaggatttgggaccagtagagctagggaattatgggcaaaatatgaagattcttgactggtactctgtaagccttcgttttcttaacttctctccccacgtctaagggccatgaaaggtcaatttgcttcctctcagcgtttcccattattattcttttttgctgagctcttagttttgaccaggaacctcatgtgtggaaatggtgaggacccaaaccttgaccccaaagcaaatgtctcaaatacaagcccctccccccagaagttaggaatgctggctgtgctcagacccctctggtagccactgggggacatatagaagacacaagaggtggcctctacttaaaaagagcccacattctcacacaaaaaaagagaaaaacagtaagtgaaatgaccacaacatgattcaatcatttcggaggaagggagagaaatgaatgcagcataattagtaatagcgcacggtttaagccataggcactctattaaaaactttacgtgtgttgatacgtttaaccctgctaacttcatatccgttttacagatggggatctgaggcatagaaaaattcagtaactcccccaaggtaacccagtgaagaagtcttggaagcagaatgcaaagtcaggcagtacagccctggactctccatgctcatccactatatgctattgcttcataggaataggaagctacagcttgaacctggccagaattttccataactatatgtccttcgtcactctaagagctggtttgtagactgcttgttggccatcagtgcaatatggaagtgaatgtgtgacaaggaggcaaggcaacaatgctgctttagggagggtgctggatatattacccatgaattagatggagtgacattctgatactgggccatagggaagaagtacaaactccttagaacagcttctacatggaaatttcaccagttaaattctacctactgcttttcttgggcaatgatgtgaggaataagtaaaaccttttttccaaagacagttcattgtactagtaaagatatgggctttggaattagcacacctgagttcaatgtaggggtctaccatttaccacctgcatgaatcttgatcaaactgcttaacctctgcaagctaaatgtcctaacctctaaagcaagagaaagatacttctctacaattttattgtgataatgacatttcatagtgattatgcagtatttagcacagtgcttgccttatatggaattttcagtagtcttggttttggcttgttatctttctccccagttacttctctttcccctgaagtttgaaagaagcggctgtgaggtatgaatatatttgccccttaagtagaaaggaggttcagtttgcagacagcattcagaggagatgagtgaaaggtttccatcactactattgattaaatgacacatagattaaaaaaaaaatatttggttggtttggcacaggtttcaaactttcagcatctctcatgctttgcacaggtgcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttcttctgcctcagcctcccaagtagctgggactacaggcgtgtgccaccacgccaggctaatttttgtatttttagtaaagacgggttttcaccatgttagccaggatggtctcgatctcctgacctcgtgatccacccacctcgacctcccaagccaattccttttctaatttgatctcacatggccttctccccctcccctcaccaacttttagttgaggctcctgtgtgagtcatcctgaactcccagtttgtgttcctgggctaagctcctaaatccactattaacttcacttcttgtacttatccacatccacgctcagtctctctgctatctcaataaacacttttttttttgctatgaaaaattaattttctagtgagcagaatatcccaacccctcaatcctggagatcaattcatccagaatttctctgaaagttctcaacttgactttaaaattgtttcttcagattccttttggaacctcaatcttcaccagagattccccattctgacttcttagttctcatcttagattttttctttgtaaaataagaattagcatgactagcagcatcatcatagttcagtttctctgtttctgtggatattgactatgactccccctccccatcattttccagcccagctccccttcctggtaggagtagctatagccaatttgacagtagatgtttctttcagtcactttattaatttagagcatgcaaatttagattatgttgctttgtattttcacagcctgtctgatttttaacactaagcaattttatttcctagttatttgttagcagatttatgttgcattttgatttttatatttaagttaaccaacatctttttttcttatactaagagagtgatttgtcactagttgtcaaaacactgcatagaagctcataacatgtaaatctaatttttgtgcttatagggaatataagaaattttatttttatttttttagagacagcatctcgctgtgttacctaggctggagtgcagcctcaaactcctgggctccagtgatcctcctaccttagcctcctgaatagttagcactataggtacatacctctatgcctggctaatattttttttttaatttgtagagactgggtcttgctatattgcccaggctggtcttgaactcctagcctcaagtaatctttctgtctcggcctcccaaagtgctgggattacaggcatgagccactgtctccagccaattctttaaattaggtctgagttttttcccaaagagataaaaccaatattgagcacttaagggtatgatctggtttagtctcccagatactgaagtttaagagacctaagaaaatacaatcctccctttttttgtcactgtaattctgagccaatagagaaaatattgcaatgaggatggaaggcaaatatcattttaattagtaataacacacaataatattgcttacacccactgaacttcagaattagacagaactgcccacttgaatagtagttcagaactgggcagacatcctttgtggaagcaaggcttgctcctgtaacacccattctatggatgcatgcagtagaatggacatttctgaaggcagcttgctccagcaaagagaaacaggaggtgttaggggctgagctaagcatacacagcttctctttgcagatcatccttaatatttctgattatgtcacttcttcaggaaagttgttaaagaggaaataaagagatgctatcagtcttgctaatggagttttttcaatgtagaaggtaacaagagaggacaggaagaaagaattccccctctaatgcttggcagtagaacatggtttgttatgttttaacatgatttttctatataaatgttgaggaagccaatttctactctggccacattaatgatgtttttctttattttgttattaaaatttccagtctctttgtatttttttttcaagccctccttatcccctctgccctagtcactcaccacttctaggtaaaataggtaatacaagttctaaatagttcatttgtaacagctgaagatatttccgttgtgaatgtcagaaacccaactcaaacgctttaagcatgaaagggagtctattgccacacagtttgaaaaagccgggaggtgcctggcttgatccagagtctcaaaggacagcacagatgattctcttcatttggtaattgtcttctgggttgctagtcctctgatccctctgattttcttatagcctctagggactcaaagctttcttcttacccctccagcagtccttgcttgcaaagaatcctctttcctaagtgtaccagcaagagctctggaactgagtgtggccgggatggcttgggttgttgccagttctaagggtggtccctaaatcagccacaagagcatcactgtgaaacttgttagaaatgcagattctcaggcctcaccccagacttttgaattctaaactctgagggcctaagccccccaggtgattctgatacaccctaaagtgtaatgaccgctttttaagtctgtagtccaaagtctgtgacagttaggggggtaaagtacattgagtggtctaggctgagtagcttgattagggtcaactttatccagtccaggtggttgaaaggtcaagaggggtgggtagcttcctaaagaaaaattacgtgttattataagataaagtaacagttgctgggcaggtaaactcaactgataagtctataatagaatccttcccacgagtactaagtggagagttattacgagaaaaaatacttggtagtgatgcccaagacttgtgtgttgtgtctttacaagggtcagagcaacaaaggcctttcttcttatagtgtgtattagtgtccagtgattctcctgaatggagaatatcaatagttttatcctttagcctgggttactcatgacctcatatttccccttatatgatgagccgtgctgagcagctgcgtgacagcatgtaatttgggcaatgcctgattgaggccaagtaaggtatctaccatattgaatatttggttttcttgaactcacccaagaaagctgaatattctgtgtggaaacaggttacacccaaaaaatatacttgagggtgctgtgataaatgatggtaacttttctgtttgtacctcatttacaattttcacaggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtaagtagaagggatcacgacttatgttggacacctttaatctactgaagctctacgtaaaatatggacataaaaataacttgtctattctactccctaccctccattcctgacacattctcgcatcttccttgattaaatggatccataaaattattaggtctggaaaggagagaggctcatgatttaatttaaaggtcttccactaactcaacactaacagactttttcctatgaaatgtagccctttaaaactattgaagaaaagcttatttttgcaaaagagggctatgatttgtattgcatctaattcttgagtattactaactacaaccacccaatttataccaaaagatgaaacataaatattttaaatcctaccattagcccatatatgcaagtttttagaagctgccctttcctcaagacattttactaccatgtattagaaaatagtcaaaacaaaaaaccaaaacaaaaaccaaaacagattaatggttgatgatgaatttaaaagtcacccccttatgttttgtagtgtacaacctgtgctactttgactctggagagtattagtaggtagtgttaatgaagtggactcgatgagtatggaattatagtgaagcatgatagaataaaatctgactattcttgtaacctcatatcaagatttaaattattcctgcattatgccagtttagcatgggggatttgaagcccactatgtcagttacacacatatagccattaaaccacttcggggattttccaattattgtttttttttttttttcttcctaggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtaaaccttgtaaagaaatttagtttttaatagagcttttcttacaatagatagactatttccagaggcaaaccacaggttcagagtgccatgcatttttgatacatcatccatatcctgttttaacaatgttgaattatcctgtaatgcaattttttccgtttttacttagactactcatcaagaaatggttcattttctctgataacctcgggaatgtcatgctgtgggggctgagagatgacaggatgagtgtcaaagtgtgggaagggccgtaatacagaggaaggaatataggctttggaatttcagctgaatcatttaatgtctggtgtcatcagtaaactgtcttagccttgttcagcttacatttacttttctttgcaaaatgaggataataattgttagtttctgtataggtcgtgagaagttttgatggcatgtctgtatatccctcagcatattattggtaacaagcacataaaaagcactcaataaatgcttgctttgttgacaatattgttaatctttactccatctatgatgaataaatttttgagatggtatatataaaatgaatgacacataataaatattggtttcctttttttgcagggtagaaactcaggtgcttatctcatttatgctgtcccccccccccccccccagctatcttattccttatctgatgaattatctcaagtgtatcaaactagttgacatggtcaccacatcctttactcattctcttttgctaattactttcctttccaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggtacaacctatttttttcttgttaagctacagccttgttgcaagcaccaagcctctttgctgcctctgccactgcctccttcctcagttgaccagtcctgtctcattctcatttgccacgtgacattgcatcaccatcagtgttctcttgtcactggtttagtatgtcaagacatgtgccacaggctccaggaatgtatgttggcagatgttttctgagtatcacatacttgccaataaaaataaaataaaataaaaaacttccctggcattgacatcaggcttctttcaatgtgtaccttggcttccagaatggctgaaacagcactggagacttttatttatactttaatacatgatgaggggaaaaccagagattttatgtagatgtcactaattaataaaatgtttcttattttggctgatagtgactgcattatttaatgcaaatctagcaggcaataggaaaacgatgtccaaatgccatgatgatggaagggaactaacatttactaagtacttactaattatcaggcattgctaggcagttctttagtgtggtatattggaacattatgggctttgatattagaaatacctggattcagctccaggtagtagctcttgttagctatgtgacatttggaaggtgatgtaacttctgtaagctatatctttcttacctataaaacagggcaataaaacttaccttgaatgtaaggagatcagaaatacacataaaatgcctggtatgtagtaggtactcgataaatggtaggcttattgtttacaaatattattttatgtcaaacatctaataatactgcatgtctacccatgcagcacaacaaaccatgctcagcctgttcctgtagatgatccactgtctcttgagatactaaatgaattttacaggtcttcctgaatccaacaattctttgcagtgtaaacaatctagttttaaccagcagatggcagaagtgaacacattcagccttccctagtagtcttgggttggctgaaaacgtgactgttacctaacttgaaaggcaaagaagttgcctgaccaaggatctatgtaattatttcctttttttctttttgagccttttggttgagccttatggtcctgtgtttgcgcaatatattgtgtttccttgtatcagttgttaatttaccacatcaaatctgttcattccacttctgtgttcaacttcatgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaattaaattgtatatagtgtttagaagattgtagaatggcagtaattccatttatcctggaataattaatcatatgaagtcaaatcacaatataagagcacatattagaaagcgtaagatactggtcaaatgttacagaatttttattatgccatcagttcttcagatttaaaagttaacaggaatcatccattaactctatgtcagtgttttccaatagatatatgtaacacatgcaattataaatttcctagtagctacattttaaaaaggtataaagtaacaggtcaaatttattttaattttgtattttattcaatttaactaaatatacccaaaatattatttcagaatgtaatagagataaaattatcaatattttgcactttttttcacattaagcctctaaacttgagtttgtattttatacttgcagcacacctcaacccaggggctacatgcatttaaagtgctcaatacacatgtcaatggctactgtattggtagtacaggtatacagaatacaaaaattaaggtgtaaataaataaagctatagtattggattaaaaggaggtctaagctttataaaagggtactaaaatgtataatataaagggagaatgacctcacttaagagagttttaagagaagcagtaagagcatcagcaaaaagaaattacataacgagttggggaaaatgtccctatccctatctacagctctatgtgcagtttggcattactcatcacatgcattacagagagctccgaccttcctctgagtatggttgattgttcaaagccggatattgtggcttgatggctccaccatctgaatctatggtgagtcccatgagcctaatagcactgcactctattgccatggagataattacaacggttacccactgagcattatgcctaccccgctgggtgggatgaagtggagggtgagtgctgagggaagaaagtccttgttgattgtacacaaatgacttggataattagcctaagtggccaggaaaaatggcccaaaatgggttaaggcataaattactgtcattggaagtttgtaccactgtgaataagcccttgcaagagatcccaggagcattttagggttctgtgtaagatggtggggaggtaaagggagagcaaaaaacactggagacactgcaaaaaggcatcatttttattctgaatctcttgtgtagagcatgagacccccaagaaggcctttgagcattaggtagtatgaggaccacaggaaacagaacaaatttcttaatttatcatttcttttacatagaacagtaaacaagtaggggatgaggttttataactaagaactaagaccagaatctcttcaagatatgttttattctagcaaatctagaatacacagataaacatatatatatatatatacacacacacacacagatagataagtatctgtatctatctacatttaatatatgtttccatcaaagtcattgacaatgacactttaagatccctaggtagtaaatgtgttaccttccctattatatcagacccatgacagcaggtaaaataaaaggcaaaagagtccaaaattatttttatttattttattgattgagtgagtgagtgagtgagacggagtttcgctcttgttgcccaggctggagtgcagtggcgtgatctcggctcactgcaacctccacctcccagcttcaagcgaatctgctgcctcagcctcccaagtagctgggattacaggtgcccaccaccatacctggctaatttttgtgtttttagtagagatggggttttaccatgttggccaggctggtctcgacctcttgatctcaggtgatccacccacctcggcctcccaaagtggtagcaaaattatttaaaaacttgctaatttagtactcttcagctctcaagtatgagtagcaaaaaagaaaaaaatcttgaaactagtatttgattttatgtctctgatagatgcaaagtgtataatttagatattaagtgcaatttctgggcaactcctagtcaacatttagttgtaacttgatacctctcaatttaagctagggttttaaaaaaaatcatacctgatttaatatgtggctggtaaatgtatcttcctatattgaggccagctttgctgcagaggccaaggcatgatcagctagaaatgtggtttcacaattgcagatgataaacatctgaaagaaatacacgtgctttgttttgaaactggcacgaataaataaaaatgacattagtctggtgcccttttgcctgcaactatttgggtttggatatatttttaaaattaaacaaattgagctttttggtgttcccaaatcaccgtgatccaaatgtctaattccagtgccaaattcctgggtggcatttgcaagagggcacaaggggtgcactcgagtgactctttcatgctgaactcctaatgtttagaagtatttctatgggctccatctgattgcacacacgtgtctttcagtctgaccgtgcactccctgaggttggctgtgtggatgtgagaaagctcttgttgcccttgttgcccgttgcctgtgctttgtcaagtctgatgcgcccctgccctgctctgctgacttggctctgaggaggccggctctgtccctggtctgcgcgtccccctctgccctactccccaaccccatctttgctgtctctggtgaacctgtagagcatttcaattgtctgtctgagtgatggttatgcagattgcgttttcatttctgtaatgttatcctggtttattctacctcttactaacctctggttattgttttcgctttttctgttcttttgctaacaaagttgcgttgaccaaagctgacctgcaaggtagagaaggttcttgttcccattaccactttggactgaaagatgccctgtgtaacccttggtatcttttctttagagatcttcaagctgtcacacctcttggacagcagcaattgtggggaggtggctgaaccctgtgttcttctgaaagggtgacagataacccagatcaatgcatgaaaaatagctatcaagaggagacctcatgggggaagaaacatgattccattttggggggtaccaaagaggtttgacagcatcccataccgtgactatacataaacatattaatttactctggaaatgataaatacctctccaagtagttgccatggaggggttggctcctcttaatttattcaccatacatagaaaaaagaacttggaaggaaaaaaaaggccaaggccagcccttatgccttaagttattattttctggatcagggaggtcatttcctggagcaggacatttaagtacttgggctttatgaaagagaatgtcattttctcttaactagttttaaagttttaaatatttctgggcatttgggagacactaatgtcattaaaatgtttcagagatttatattttctattggggattttggttgagcactttaatttcctgttttgtgatcgcaggaaaaaagtactcttgaggaagaagatgatctgtcattttaatcctgaataccctataaaataccacatgtgagatgttagtgaatatctattgcagaaactacttcatccactattcaaagaggcatcttacaaagtcagtaatggcccactgatcctatggtgccatgctgctatgtctcagaataacaagggaggaacaagcattttaggtgtcttttggctgattgtcaagcaggagactgagcctcatgacctctgctgagtttgcagtcagtccaaattgttagaagtagttaaggcaaaggtaacgttcaaaaaattacttttcatctaaaaagatcattgactttgctgtgactttcttgttatatgccatgtagctaaccagtacaagcgcctatctatccagaatacatccaccaatgaagactctgtcactattttaccataactttgtttttctttatcgcctcttagcagattcacatatattttaatatatatttaaattaaataaaagaatatacactagttaggacttaaagtcagaggaagctttacaatagctttcagtttcaaagtatagagggcccttgtggcaatactgttgttttagacattatgtttaattgtcaagaaagatccactatgtatttctctgtaaatggaagagagagagaagggggcaggactcaatctgaatgcaagacaatccaaggagattgaagctccttaggactggatttagcggattaaactagacaactacatctcttccctgactttactatcacgcagggtaagaactatatggattttgaattcccagagcttagcatattctctcacctagaaaatctggacatggcaaaataatctgaaagttctcatccaaaggaataatggtttgtagggagaagtgagtcattgatttctatgcctaaagtaaattgtttaccaaagcgtagatacagatttagggacatagtggtttggaatatattgatgtttccttttatggaagctgtctaggcatcaatatggttttaacattattactttattggcacgaactttcctccattcttgtaatgacttgacagtctctttgtttgtggcaggagctgctttttttttcgattatttggggccgtcttactctttccctgttttataggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgacgtaatgagtctagatgagtcaacagcttaagtcctcttgttattgtgtggttggggtagtgttttattttttatttaaaaatttttaacttctccagtgaatgtgttgttgaatttaacaggaagttagtgtcagctatgcctgtgtatcagggactaggtactggggatgctaggatactgcagatgagatgcagtctctaacttcaaagaattccacagatgatcagccaataattacaatgcaaagtgaaaactcctatcctagagacatgcgtcctgccatgtgagcatgaaggaacacactggatcgtgtagggtcatggtggtcatggggagtgctcaggggatatcttctcagacagagtttgagctgagtctgaaggacaagtatgttttagatggatgaacgatggaagcacattcgagagcttggcttaattgggaatctacaagaagctcaatgtggctgaaataatgtgtgtggggggatatgatagcacatgaaatgggagtggtaggatagagacaggtaatgacagacttttcctgtaaggagttggactttatcccaaggatgctgtgaggaggacagagatttgggttggattttcattttatcaggatcactctgacactagaatggagaaaggatgatgcagacagaaactagaaacagagagcagattcaggagtgaagcagcatattccaagacagagggaagagacatgcccccagtgcctgttacttgacttggtcaaggaggtaaacaagtttccctttcacatgaaacctcaaagagcaagaaagaaagtgaactctttctcctgtttgctgcacacaccctctccactgctacactgttattctggttagtagcacatgtattttcacattatgacaaaagatatcaagaaagaagtttaccgactttcctggtttcaggccagaatctacatctctctaggtcaacacaggagacaggagctctccacggtactcctgtgatccacgggagggaggttgccttgctgagcagtgcagtctttgtatcagtgtaccttggacagaatgacagcttctacagaacattcagaagtaactttctaattcctttttgtttttaagaagggtattagtggaaaggaagagatttcctaaaagcctattcatggaagaaaggagctgcagaactataaaagaaatattaagattgacctgtttggtgtgaggcagatgacataaattatgagaaataaaagaataactcttttttgtattaggtgattaattagaatcttcctattccatctttaattataacttctcttagcaggttttatttctgatgtttaatgactttttttctagaaatgtaaggtgtccctctgcccagatggtgaacacgtggtcaggggatccaggatccattggatctgggtgctaagtgctggctattttgagaaagtcaatcaatgtattgggttcagatgccttggaaatctcaagattctttaaaggcattttagaacagagttagaattagtcaaacacctttagttaggtaaaggaaattttaattccccaactgtctttactatgatgaatattgtcctccacctcattttctccgaaactgaagattgtatcacattctccattgtattttttgttataaaatatagtacttgacctactataagttcctcaaaatgctttctattgtggaaaataataagagagacataaattgcagtgaacttcccattattgttcttgtgtccttttcctccacattatacgagagaggcgtacaacacaactgtgtcagtgtggcacactaccaaaatgcatcttgtttctggactcctcatcaactgtacacccaacttaagtgggaggaggaaacctgattattgtcctttctagcagaattgctgatgatctttattgagagtctccttgatgaaggcatacactaaggacttggcaggttgtatctccattgtgactacaaccttagctgatagatactgttgtctgtttcataggtgactttataggtcttgcatatgttctttcatttaatcttcacaccatatgatgcagtagaaatacatatctcccttatacagatggggacactgaggtttagagtttaatatcaccagcccaaggtcacattactagtaagtgattaaactggattttaaagcccatgacctttcgcctattatgccgtatggtgtgagtctgggtttgcttatttccaaagcagaaagagtacatagatgaccagagagtatctgagagtgtcctccatgctgactttatggtagatggttttcatatcaacaccatttcgaaaagttctagataatatttgcacaatgttagagcaaagtattttaaattacctctttttttgttgttgttgagactgggctttgaaactccttctctctctcttttaaagtatattccactgccccagcagacccctacatcagtgcctagaaaacaaggaaaagcagacagactcctcagtttacattttctaaagaatcattgacttatgagggattgtgtatcactttgaaaagagttatttgacctttgtgacccaggcatcccatgaaaatagggtgggttgaggaagaaggcttcatgctaccagccatcctctcactcttacaaataccctacctgcagcaagtatcaactcccacctctctactgtcatggaaggtgctgtgggtaaatcactttactcttaagctgtaattattctttttagatcattgaccatcaagagcagtgctgtgctagagctggcactggcacaggaatttctaggaattttgtaagccagtttacatgaggcaacatgttatggcttgaaattggctatgaggggagtactaataaaaccaacacatgttacaaatcagttttattttccttttcctggggtgctggttgttaaacatttactagtgatatatcaccaataaaaggccactggggataaagataccatgaagccatctcagtcaaccaattcccatccatggccataaccaattttatacccaacgtattatgagagggttgaagtggttgaagagaaaagggtgttagtgaaactgctccaaatgttagattttattctttgtctttttcactgatcactctaatcatgtgacctttttaaaacctctgtttgagaagaggaagccataagcatctgaacatgcttgagaagagtggttttgatgccttgcttagctttggtaaggcataggtcctgacttcaagacaaaaagcatgatcttgggaatacagccacccttaggtctctctgacaatgagattttataataagatttaggaccctattctctggcattgccttatgttctataaaatgtgacctagagtattcgcgtctcagtggattcacttgacatttttaagtgatcattgctttcttattttaaagctaaatataagtgaatttggcttcctccagttaaaatgaatagatcttatgttgtctgtaaatgactctcttcagaaaagccaaggggactcaacactgtaaatttagaaatactctgaaagctatggaagtagctttgctgaagggtccaagacatatattcagctaagtaaataggctatccttattatcaggaataccctctgtattagttagggttctccagagaggtatcatatatatcatatataggatatatgcatcttatatataatatataaaatatatattatttagatatatacatcttatatataatatattatataaaatatatattatttatatacatatgtataaaaataggaattggctcacatgattatggaggccaagaaactccacagtccgctgtctgtatgctggagaataaaacagttggattctaaagccctgggaatgggggtggcaggggcagaagtggcatgatagtgtaagttctgctctgattcgaaaagcccaagaaccaggagcacaagtgtccaatgtctgagggctagagaatatggctatctcacctcaagcaaagaaagcgaattcctccttcctctgcctttttcttctattcagaataggaccacaacagattggatgatgcctactcacactggggaccatctgctttattctcttcaccagttaaaatgctaatctcatttgtaaataccctcaaagacatacctggaaataatatttcattattattatatataatgaccaggtatctgggcatcccttacctcagtcattttgacacataaaattaaccatcacattctcctgaagactctcaactctttaatttttatattttagcagtcgagactatagattgctcaggtaggcagtaagagtctttcataatccatttgcattttcaaaaatttccctgtagggtttctatagacttatttatatgagacttatataaatacacacacatatacataaatctatgtatattcatcttttttctgtacttttttccttccacccaactactgttcactcatttttttcctataaaacaatgtaaattttaaaatgtgaaagtagaaagattaggcacttaccaggggtagaaaattaaactaaagttggaagatctctttagacagttcatggcatgtattattctgttctcatgctgctaataaaaatatacccaagactgagtaatttataaagaaaaagagacttaatgtactcatagttccatgtggctgggcaggcctcacaatcatggcagaaggcaaacgaggagcaaagtcacgtcttacatggaggcaggcaagagagaacttgtgtaggggaactcccctttataaacccatcagatctcatgagacttattcactatcgtgagaacagcatgggaaagacctacccccatgattcaattacctcccaccgggcccctcccacaacatgtgggaattaagggagctacaattcaagatgagatttgggtggggacacagccaacaatatcagcaactcttataatgctccttcccatggaagctgtggtttgttgggacaggcaaaccctttggttaacacggaattctactatgataacttcacatttaggttacaccgatagagtctaagccctttgacttaagcccttcactccttgtgattaaagttagtgaatgttgatagatcagcctcacctggtccccactcctgggtcaccagccttggccctctaaaggaatggacattgagaagacaaacttgatatggcctccaggcctgtcacttctccttttctcccttaccctctgcctgctgcaccctacatttctccacccacttcttgtctggctagaaccaggtggtgctgctttagcactatttatgaatttcaaattggggtgtttgagacataggtttggttaagtcttatttgggcaataacagagggaaagtgcattctgatactagtgttgtgagctttaggaagaaagtctatttcaaggacctacaaacaataaaaaatactctatcaactttggttttctaggccatgaagaggaattgactaaatcagtgtacacgtgctgtaagggtggattagagcagtaacaggcataaaatggttgtatcagacaattcttaatgagaagaacaatcccaccatcaagaaaaatgataggaaattttggcagccatcagaattatctgataaataaaatgataagggaatgagatgcaatttcatgttttccagcaaaccaaaagcagggctggaaattagaaaccaaagtactaacaccattgacatcttattcagtctttccagacacatttctgttgtcttgtcactttctgtagtatacaaagaaagtcaccatcttttctcaaagggatatgtgactattttcgtgagagttattcacatatcaagagcaaaaataacttataccattcctatacaggaacttcctaaggcctttggatgttttaagatattaataattaataatgacaatgataaaaaaagacttcataaatatgtaattaaacaaatttgtgctgtcttagaatgtctggaattttatgttggtttggaagagtgttttatgaaaaattatgattattaagtccccagaattgtctgtcatgcttataaacgtaacatttgatacagatttctgttcataaaattggacaaaatgagatcttcctgtttaactgaattgaaatggtatttgaaagttttccttgtaaaaaacaaaaacaaatccttacatcaagacgtcatcttttcccagttgtaggtcagaaataccttaagttactcttattaatccaatgacaccacacatgcacattccccactctggcttacacacatccgtgagaggttaggtgagtgggctgcacaattagcaagcttgggtttgagacctcaccctctcacttgccacctatggattttggggaaaattatgcaacttttctgtgtctcagtttacttttctgaagtctttgccttttgattcaatcaacattttaaaaattacttaaatttgaaattatggagatctcctatgagaaaataatttgtttctctgattctttactacttttaattatatttgcttcatcatgtgcttatgaagattaattgaattaatatcttaaaagcatttagtatagtgtctggctcataataagcactaggtaagctgtgtctattgttatatcctctttctgatttgtacaagattattttatatcaatagatgtttagtgggaagcactgttgaagcttttggtttttctcccccaagacatgtttttctaatttctttgacacactgctatgtgaaatgcatacattaaatacattgacataaaataggctctgtttaggaaaggatgtacttaaacaggttgaagtaagaataggagctcacaaaatgatcatctagaaattgttctagagtctagcccagactctcattcattcaatagttattacatactgtacttgggcttgggaataccaaagagttcttgtcagcatctggtgagtctgaaatcaaaggacacacggccaattaaataccaccaccccacccaccctaagaaaaaaatgtaaataaaaacagtttcaagtaagagattacttatgtgagctcttattggtaaattctagggataaatttttacaagaaccattttgctttaaattctaaatgaatggctttatttctttattttttctttgttatttagttctttcttttattcaataatattttgaatattttgaatagaaccctcacgctataccaaatacaatatcagaaattagagatgtaaaggtgaccaagacagacaaggcttctgcccttgagaggcttacggtccagtaggatttgaaagacagtgaggaacttaatagttctgacaaaaaacggatgcactgaccagtggaacaggatagagacccccaaaataaacttatgcattatggttaactgattttttttttaacaaaggtgccacaagtatgcaatggagaaaggatggtctcttcaataaatgatattggacaaaatggatatttacacgcagaaaaataaaattgtaccctttttataccatatacaaacatcatctcaaaacatattaaagattcaaatgttagacctgaaactataaaactactagaagaaaacgtacaggaagtgctccattgcattgtttctgggcaaggatttcttggatgtgacttcaaaaccacaggcaacataaacaaatgagattgcatgaagccaaaaaggttctgcacatcaagaaaacaattaatagagtgaagaagtaacccatagattgggagaaaatatttgtgaagtgtatatctgataaggcactattatccaaaatatataagaaacacaaacaactcaaaataagaaaacaaataccccaatcaaaaaatgagcaaagaatctaactagacacttcttaaaagaagatatgcagatggccaacatatatatgaaaaaaatgctcaacatcactcatctttgggaaaatgcaaactgaaaccatgatgagatatcaccttgcacctattaaaatagctactatcaaaaagacaaaaacaacaacaacaacaagtattggcaaaggcttggagaaaagggaacacttgtgcatttttggtgggaatgtaaattaatataaccattatggaaaacagaatggaggttcctcagaaaactaaaaatagaattaccatatgattcagcaatcctgcttctgggtttcagtccaaaataattgaaggcagtacgccaaagagatatctgcattcccatgttcattgcagcattaatcacaatagctaaaaattagaagaaacctgggtgttcatcctcagatgaatggataaagaaaatgtggtatatgtacacgatgcaatacatttgctcattttttgattggggtatttgttttcttactattgagttgtttgagtttcttacatattttagataatagtcccttaacagattgttttattcagccttaaaaaaaagtgggaaggctgggtgtggtggctcatgcctgtaatcccagcactttgggaggccgaggcaggtagatcacgaggtcaagagactgagaccatcctggccaacatggtgaaaccctatctctactaaaaatacaaaaattagccaggcatggtggtgtgtgcctgtagtaccagctacttgggaggctgaggcaggagaattgcttgaacccaggatgcagaggttgcagtgagccgagatcatgccactgcactccagcctggtgacagagcaagattccatttaaaaaaaaaaaaaaaaaagaaaaaaaaagaaaaaaaggctggaaattctcttatttgcaacaacatggatgaacccggaggatattatgccaagtgaaataagccaggcacagaaagacagataccacatgatctcacttatatgtggaatctaagaaatttgaactcatagaaatagagaatagaatagtggctataggaggcggggggaggggatggatggaaaaataagagatgttgatcaatgggtacaaagtttcaattagacaagaggaataggctttggtaatctattgcatagaatggtgactacagcaaataatagcgtattttaaatttcaaatcattagaagaatagatgttaaatgtttttaccacaaaaaagtgctaagtatgtgaggtgattgatttgttaattagcctgatttaccattccgtgttgtaagcatatattaaaacataacattgtatcccataaatataaacaactattatctttcaatttaaaagaaattaatttaattacagtccacgtaattgttattagttaagtaaataggaagacatgatgaagagtaaaagttctgctaatgggggcttccttaagtaggatagtttggagaaagctcattttgagctgaaactcaaagaataaaaatgaaacagtcatttgaatctggagaaagcacagttaaggccaagggtccagcaggaagcgcaaaggaactcgaagataggggtgggcatgaagtattaaggcagtggtccaggaatatgagcaggcatctgaaccacctggagggcttgttacaactcagattcctcaattctgcccccagtcagtaggtctgggtacagccttaaagtgtttttctcataagcttccaggagatgcagatgctgctggtttaggagcaacactctgggaatcattgtgttaggaactaaaaacaggagagggctgtagcactgtgagctagggacatatggtaagaaatgagactggagaaggaggcaggggctcctaggagctcaatcttgaaaggaggttcaaggttagttccagattgttgagaagttgaaagttctattaagtccttagtgacaatactgttgttcttggatgcttacaatgtagtcagtcttccggtactatctgattctacatggcctttgccccttaatgcaagtgaagcaaattcagtggaattgataaataacctataatccccgccctgtatttggtccctgatgaacttctgacaaatggaaaagattgcatactttgcagagtgcagacatgctcctacactcaggttttggaagcatgatatagcaaatcaagggtggttacaattcagatcaccctaacatttactggaacactttctgcatcttcacaatagacttagtgccacaaggacctaaccagagaatattacctgatttctaatagcaagcagctttcaaacttttgatgataaaatagtaaaaacataaagcaattagaggattatatgaggagaagacagtgcaatgcgtaataaagtgctaaactgaatattatatgcaaaaattaatgacgcagataataattgctatggccacaacaaagcgggagaattattgtttgaagttattgactaatgtttcatttgaagaaggcattcaggctggtccttagaaaaatggttaaaatttggcagttagagggaaggcgaaagatatggaaaaggcttcgtctttagattcaatcaacattcaaagaattattgtgttttcccagagtttttgctgttttactgccttttacagtaaaactttccataaaccttccatgtgtttctgattattgagtacaattgaattactagccaattgtatggtgagagctgtttggccagggagcccctgtggacttctcagaagcttttatcctttgaaagaagctgtcctgatttaccattgttaatgaaacttgtataacacaatgcttgagtttaagacccactgagaacatgaccacatacctcctttcatctctacatgggggaaccacatggccaataggagctgcagaaagccagcagcagtactgtaaccccagtgttagtaattgttttgaactttcttatgtcatatcctcatagcattgtcttatgagtgatggcctgtcctgcttccacccttcatgaataaatacaaaatgccttgccacccagaagacgaaccctttgtagtcgtgcatctcttttgaacatgcgtctttaggaccctgtgttctttcatttcagtattcttgcttttgtgaggcttacgttagaaactgtgaaatatgctgttattgcaatggtaatatgttttaccctgtcaagtgcttttatgcattagttcctgactaatacatttggtgagtcaaagggctcatctcgtttgctgagattctctgggaaattcatggagttatactgaatattaagatatttcctgtgagctcagataatcctaaatgtatagatttatctttaatcccaaagttaaggcagaaaatgtcagtaaaagagagagaatggttgaagagaagtgccaggcggaccgaaagagtttaatggcaatctgtaagagagagatcatcaaaaaaattttaatgcccccacatgtcagtaaaagatttggagaatgccttcaaaataggtaaatttacttgtaagttatatacatgtactattattcttatatattaacatatgaaagacacacagaaatagaaataatttagaattaattaaaagaaacacaatttctaatattttctttctatagcacaaatgattctcttttgcatgctccagcgcatgcacactccatttaagagaatccatttttagcttggtgcagtggttcacacctgtaatcccagcactttgggaggctgaggtgggcagatcacgaggtcaggagatcgagacgatcttggccaacatggtgaaaccctgtctctactaaaaatacaaaaaaattagctgagtgtagtggcgtgtgcctgtaatcccaactactcgggaggctgaggcaggagaattgcttgaagctgggaggtggagattgcagtgagccaagatcgtgccactgcactccagtctagcaacagagcgagactgtctcaaaaaaaaaaaaaaaaaaaaaaaagaattcatttttagaatacctagagcagcagtgtgctgtagtgcaacggctttcaaacttcagactgcatttgaatgtcctggaagcttgtaaaaacagatgtgtgcctccctgcaaaagtttctaattcaatgggtctggggtgagctccaagcgtttgcattcctgacacattcccaggttgtggtcgtctgagaactacacattgagaaccactggtatagtccacagcatgcgttttagagttactttacctaagttggacatcagcatccttcaattaccaaatgtgtgaccttgagtaaattactgtgtcttcccgagctcagtttcttaaaatctgtaaagtggaggtaatcataattacttacctcttagagtacctggagagctcagcaagataatgtaaatacattgtttagtacccagtactcgccccctaaaaaacatcaatacatgttggctgctaaatcctccttcttctccttctcttccttctcttcatcattatcaatatcattaaacatctttttttatgtcacgaagtagatatagggactgttggtttcaggattaaaaaaacactgtgccttaatttataagaatcatgggaatgattttttttttctgagttagcattctacattaaaaaaagctataatccaaatgagatatctttctagttgaaaggtagagatgaagctattttgcaaagtcaacccgaaggagaacagtgtgttcagccctctcccttctgtgtataactgttgatagtttgtggctaagtgtgtatttccgtcatcttttgtatatactgagttcttgttgcatgagattgagttgacaattttggtggtgtgtcttcaaatgtttgggggcatgagaatggtaaattcaggtgatttccttgaatctaatttttaacatttcttctctctctcctttttctttttttcccctcttcttgtgcattactaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgagaagagtgaagagatgtgtcttgcttaacaacactaaatattctcccacttgctcactccctgtgttttttctttagattagaatagcgactgagaaacaataaccacagcagcaaaccatttcaggcaatatttttgttgtaagggcttcagttcttcatgaattaaatcaccttatcttattgaatttaactccaaattggttaataattttgagactctccccttttgcattgcctagaattttgaggctatttaaagggtatagctgttttctcaaaaagtttgagttctctgaatttcttaggccttacaaatgacaaagacattcaagagtttattttttacaattagcaaagcttaaagcgttcttgggtatctttcagatatagggtagaaattctctctgactaaatttattggtatctggtttatatacacatagctattctgtatgtatgtgtgtatatatatgtgtgtgtgtgtgtatatatatgtatgtatgtattttctattttgtgagtatattttatatgtatatattatgtatttggtttttattggaagagagtcttgtgattgttaattgtgtccactagtgatgcttctggctcgtgggtttagttctgacttcatgaaggtgcttctagcactgatggtggagacacctcaatgctgtgggcatctataacctgtgtctccacttctttctcatgttattttcttgatgtgaccatagtaaagatgagcacacacttgaaatttctgaataaccgtggcaaagagatttgttgaaaatccctgactctgtgggtcctgctaaccttctgactttctaaatgcagcctttgttttataatccagactcatttgacctcttggttttagaaaaatgatgcatgatgttatctgagaaaatagtaaagtcacattatggtgtgaccacatgggagcagacaccaattacaatgctatgccccccagatctatgtggtttttttgattctttatttctcagctttttatctgtgtgcagctgtctgttgttgttctttttcccgttttttctcagtagttttggtcccatatgctctttcattctcttaaggtacactgaggagaaacaagtggagaagttggcaatatagagagaaaattatgtaatacgcattcatctaattacataagcatatgtctctgtatctgtcatgtgaaggatacgatgtctggagaaagttttggtataagactgctcttaccaagtcttttggtattattgaaagtcatgttgccatatttatgatgtggaaatactgtttcactctgaaacaggtagttataaacccagccagccagagaacctgaggaattatactatatgctctttctttttcctccaatttgtcagtatagcactcactaggaaggcttttttctctaaatggtggcataatgcttctttatcctcacaagtttatttcttgtcgcatatacgtccctttctgggtagaaaatggtcaggaagagactctccacacagaacaggtataaaggtaagttatcgtaacgtggtgagcacgcacaattttcagaaggtaggtatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttcaaaaacatttctagtaaatctaggtttagggcaatacattttgaattttattctgtaacaatgcagctaaatcttttcattatagcagacttgggaaactgcctctctaacaggagctacttgcctagtcccccacctggagattggaccacggcttctgtgattggatagatacatagatacatgcaaatgatgaagttcacatctatttttttttttttttttttttttttgagacggagtctcattctgctattgcccgggctggagtgcagtggcacaatctcggctcactgcaacctccacctcccaggttcaagcgattctcctgcctcagcctcctgagtagctgggattacaggtgcctgccactacgctcagctaattttttgtatttttagtagagacagggtttcatcatgttggccaggctggtcttgaactcctgacctcgtgatccgccctcctcagcctcccaaagtgctgggattacagggaagtacacatcttagttgtggagtgtgataagtatatagaattgagacatataggatgtgactgtgaagtttgaatataaacttttaatgaaatccaaccaaatatagcagaatggtagattgtttaaaattattacattggacgtttctgtttccaataattggtattcaagttatctggaagaccttctgttttggaactagcagcaaagccagtttgttctacctagaaaaagcagtctcactatatcatagaccattattttctatagcagccttgacccttagagttataattggctatttcatctcacaaacatcttcaaaatgaagttacctgcatgatattctatatgcttacctttgttgataaatttttggtggcgtagcctgtatcaggactcaagtgttaaccttcatcatcaccggcagacttgaataggctcatgcttatcatcagcaaaaagtggtgggggaaattgcaaagaaagataagctcatggaggaggaagaataatgatgaaaaggaatatagagaaaatcagaaagtgggtcttatatggaagagcacagaggtcatcagcaattgctttggtaacatgcctgccacaagtggcctgcctttgacctaaataacagaaatgggtcacagcattaaaagtcgagtgccatcaaggaaacctggcttttacctaattaattcctgcaaagagagtgttctatagaatgttgcatatagctcaaacaaattgtatccatttaaatgctatcataggaccatgcaaataggttagagatgaaatttaattgtaaaaagcattttgtgggggaaaaatggttatggatatctcattttccagaagctgtttctcagggcaacagattgatcctcaattaatgaacatgaaaacacttcagtttattactacatatccaaaaactgaaacttactcaacagggaaatagctaggtcttatattttccaaaataaggtactaaatccatcatgtgtaaaaaagttaatcatatgtaggcatgacttgtaaggctctaaaaatgtctgcattttagggtattcctttttcctagcattggttcttttatgacctttgtgtttttcttgcctgtttaccaaatatgattgcctgacaatgttaatgtgctgttacatagatgttgcctctatgagtacagcgtacattttaaaacttagtctcatttagtgtgagttggccaagcctggatgttttcactttatttctttattctttgtgtgaccctggtgggttgatggaggcagtgggatgaatttcagtttcactcttataaacatagctgtgcaaagctgatattctttagagctgattgtcttgtataagagtgactcccttgtatggggttaggaaacaaaaatcctctgattggaaatccaagtgtaattgatttgctaattgtcttacatagttttagatatgaccttccacaatgttatgtaatggtaaagtcatggggagtttcttttgggttgacttttagggctgttttgattctgcaatctaatcatcccagaagaaatgttgagttaatgtagaagtcagtatgatctgtggaagaaaacataagtaacattctccaagataatcttcagttctcgtgaaacatttaaaattgagggagctggctattcagagggtgagcaccacctgaaaatcaacttaatgaaagctgtcttgggctacattttaagaacaacaaaagaaatggaaccttacaaaggttcttgataggcatattcttttttgatattgggttcttattagtattttaaatcaggactgagaacctgggaaattctagcatgttgtagccatggcagcaccaggcaaatccagaatctccttcctgtattttgtggtaatattgtcactgtcagcctgctgttgagtttttctttccttcaaacatcgaaaaatgttgtgtagaatagaaccctcctgcatgcacccacacatgtgcaaaagggttgtcatttttatggactttgtgaaaatagcagttttaaacatttcatacctatccttaacaacattgttggcttttaccatgtacatgacaactgttttgagtggcatacaatttgggggtttggttattgcttctggtgccctggagaagcacatataggacagtctttggcacatgagtccttaacacacatcaagttcctgactttatgaggtgggtgctcatcatggctttgtggggtgaagtaaagggaatgaacgtgggtcctcagcccacccttaggagctggccaccctgtgctacattgctggtcacacactgcaggatgcctgttggagaaattcctaggttcacactggcatgtggtaatagatgttctttgcttgcaacaaatcaatagcaagcagctgtggatagtgcagatagtggagtgtaaagcgtctttttcagacagttttctgcaggagtggctattaagctgcagtgttggctattgattggccttttgctttttatttattgtgtgggtttatttatttttttaatgtaggttggtgtattgattaaatctgttaaaaacacatttcccattcaagcttcagaaaatacaagcaatgtatgcattactcagtgtgcaaagaaggggacagatatgtgtatactgattctgtctcttgggtccatataggtacatagacattatgttaaaaacctatgttgttatgaacctatgttgttccagacctattggtatagcagtaatttttaaggatatcatagtatagtacatccatgtttttggttatgtgttcattccccgccattgttttcagactctacctgcccagcgaataggccatatgtaagaagttcacttgtaaaacaattgtttgttgcttagaatgcactttatcatgtattgattcattcactcaccaaacatttcttatttgcagatataatcatgaataagagagttttgttctcaaagaccttctagtctaatggggaaagacacatatgaaggtgcttcagtagaaacatgaacagtgtatagcgaggagtcataaggtggagtaatggcagctgtccccagggttgagactctatgaagagcagctgcttttaggatggttttcattgaagatgagccttgaaatttttttttttttttttttttttttttttttttgagacagaatctctctctgttgcccaggctggattgcagtggtgcgatctcagttcactgcaacctccgcctcttgggttcaagtgattctcttgcctcagtctcctgagtagctgggattacaggtgtgtgccacacaccacgtccagctaatttttgtatttttttagtagagacggggtttcaccttgttggccaggctggtctcgaattcctgaccttgtgatccgcctgcctcggcctcccaaagtgctgggattacaggtgtgagccactgcgcctggctgccttgaaaatttacaagtaggttcaaagcaaacatggtatggaagagggctggaaaggaaaggtagcgtgccagcaggcaagcagggaaaatatatgctgcagtcactgttaacattctgcatgtttccttccggtcttcattttaagcattagcatggttcagatcacattctgtttgacatttttgccctgctttgtttggtttaacactataggctatgcatttttcaagatataaaaaaaaattagatttcccaacttctttcaatagaatgcatgttatggtgcccaactcttggggagaaactcccctatgttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatcaaactgctttaaatgccagtcctgagtctttctatctgtgaagttgaattgttcacttagcttcctgaaactttggtgtaacataaggagtgtaataggtacttggtaaataggattagtggtagtttttattgtagctaattataatatttgacaactgttaagtccttatcatggtcctgacactctactaggacctttataaggatatcattcttttaatcatccccaaattcttaagaaaatattatagtacgatactcctgattttaattatgacaaaactgagatcacactgttagaatatagctgattgagggtttggtcccaggtttgtctgacataaaagttcacattcttattcgatttgctgccacttagtcattattagaaataacagtttaacatctgtactgatattagactaggatgcttaattccatgtgggcaagtcttcacagacaatcaaactgcataaaaacatagaactgggaaagggaaattgtgttcttgatgattatttgcatcatattgtggaattcagaacatttcaggtcttccttcttaacactcagatgaggccatttagaattaaaatgtctttagccattatagaattagagtatcttgcccatactccaaactatttatattttcattctctgttgacctagatcttctgatttttatgtgtttgctttatttcaattccaacatatgtcatacagcacggtggacgagaccactaatgtgtaatggggtggcctgtgttcaaatcatgactctgtcccttaatatctatgttaccttggacatgataattacagtgcttctaaagtgcagatattttgtaggtcctatcttgtaagaataaattttacaaacataaattgaataataataaattgaatgtgtagtggtgaagtttaggagatatggcacatgatggccctgccggctactcttcgatattactttcaaaaagttaaaaacatgactcatacaaatataattattataaagttaaaaacaaaacactcatgcaaatatagaatgaatgtgtgtcaaatttatttaactccataatgagagaaacaagatggtaacagtgtaaacaagatgacaaaagactatttgaagaactggatatttataggccttaagaatattaaaatacaaattttagatttaaaagtggtaaatgtcctacaaagcaaaaatctcttaacctttggtgttatcttttctatggaacatctgtgctgaacaaaaatctacaggttcagagggcatcttctgtactctgggcccccgctaacaataaatgtcagtgccagtcacaggttcttctcccatagagctaaatgtttctcgggtgggcctgttaaacagtgtccttttataacattagaaagacacatgatttttttcccctaacttttgccctatgttttggataatttttattaatttatattcagtttcatttttcttttttaccttgaatacctctttcatacacaattacgttttttaaccgcttaacagtgtgccccaatgtgctgaattcattgtcatttaaaccccacggcaaccctaaaagtagatactattgtgataccagtttcatagatgagagaactgagacagaaaagtcaagtgatttgctcaaggtgacaaaactattaggttgaggaacaaagattcagagttatgttagtctgactgcaaagtctgggctctggactgccaatatcttcttaatgcctcagggaaagtttcctgatgagaattcatctgaattcataggggtttagattcacattagccacagagcttaacgacttttgttagcatcaattatactgtaatttctagtgtctgtgttattcttttgggggggatgctattttattttattcactttaaatgagggcatttaaagtaggactgatttgctcggggaacaagatcagaatttccatcaaataagtgccattttgcaggtttggtacatctaagcagggaggaggctgagtcctgagaagtcagtgaggctgagaggggcagcatagctccatgataaccaggtcccagaaggcgagacagatgcaaaagaaacgtcaggagtggcagcaccaaaggttatttctctgcatctgtttttattctcgggcccacagatattccatggagccaaagggaagtcagaagataacaatgaaacccagggtcttctaagagcagaatgaagctagcggtactcttaggaacagttctatagatgtgggttgtagcttgttgcccatgggaatcacacttgcttttaagttccatcaatattaagaagggatgatttggagtattctcaagctttatcagggctaatattaatatgtgtgcaatactaaaccgattcagcaagagccaggactgcgtgcagctttgtttttcacaaccctccctgaaaataagctgggactcataggtgacacattggtttctacaaaccccagtagacacttggtcctatggttcaagaaaaaatagtctccataattcaaaggcatatagcttatcatggattatcataagctgttggagtttgtggcctcaataatttcatttccaccatcttccacatgctatatttgtagaccattttcattgctgtgtttaattatagcccattcatttctggtgtccttggctagttacttacttaaggtgacggcaataatccacttagagcctattgcttcacggaagacaatttttgtattaccatgttagtcacatacaggtgcaattccaacatatttttcaacatggacataatttcctatagttatttccacatctaaaggcacaagaaagatctaaattactttactttgtcttgtaaaatagaaataataaatataattttgttcttttcatttatttttctcctctactttctttttagggaaggaagagatcattttttgaaggtggtaaaatttacatccagcaaaatgcatagatcttacatgcattatcacaaatgcttatacccaagtaaccaacaccagttaagataaaggatagtttcatcttctcagaaacttttcttgttccctttccggttagttcttctctttaaggtcattgctgtttgaatttgtatcagcatttgttatttttgtctcttctggagtatatataaatggaatcatacaatatgtgatcttttaggtctgttttctccagctccatgtcagctctgcattctagccagctgagagtctcttctgagtcttagctccatctatataactgcaggagttggctggattccagctggaaccttcctgcctgctccatgatgcagaaattctctccaggcagtaagctggagcagtcttaaatctcacagtttatcttctctatttcagaaaccactgctcttctttgcctgatgtctcatgtctcatgagccattgtttcatgtgttgtcattttcccggttatatcaggtcagttgtagttccagtctttgttactccatttaggttgaaaattgatgccaacctattcttttttacctgacttcacctttgcactgtgagattagggtgaaggtagcaggagaagacataacatgtaatgggctgtgcttcaagccgcaaattctaagggttttctgaggctttacatcagtcccagagtgatctggcagtatgtaatattctacaactgttttatttattcatttattttagggaaaagccttcaactccagtgataatccctctgtagtcaaagaaccttcttggccaaagaaaacgttgcaagaagctgcgcaaagctagttaaagacttgccaatgtgtctctatcaagtatttattaatttgagtgtttctgttaggagggctacattaaatttttttttttttttttgagaaggaatcttgctctgtcacccagactggagtacagtggtgccatctcggctcactgcaacatccgcctaccaggttcaagcaattctcctgcctcagcctcctgaataactgagattacaggcaccagccaccatgcccagcttttttttttttttttttttcagtagagacggggtttcaccatgttggccaggctggtcttgaactcctgtcctgaagtgatcctcccacctctgcctcccaaagtgctgggattacaggcgtacattactttttacttccactccctctgaaaacacttgattaagctcagtgattgcaggcattgatttgacttgaaaagctagtggttcttattattttcttcacttagaattatagtttattttctcaacctacccttttcttgtggatctttgaccactgattcatgtccctttgccaagtgaaattaacaaatgttttcaaacaaagaatttggagacttcagaaaagtggagttgtttctataccttgtagtgttttggccattgactgtccttattttgatcaccaggcactggtttgcatttatgattttgctacatgcctacggaagaaatgaaggaaccttgcattattggtacctttgatttaactgagtttttttggatatggaaattataaaagctcactgctgaaaatgtggaaaacacataaaagtatgaggcagtaggaaaaaaacatgcttaatttcatcaactattaatatgaccttgtttcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctatataaaagggaaatggttttacagcggatcatggttggagggaaaacaccgctataacataatatgggaaaagagcctcttggtcccagtttcttctgtggcactcacttccaaagtgatgttgtggtttatttcacaagatgagatttcttgtaacagtctagtactctagtgatcgagtgagatagtagaactttatcgtcaatcatcaaatcccacagttttatgttgaccaaaatcagtactacatgattgaagaagttggatgcattatatactgaaaatgtaaaacacaaaattcccctgatttttttcacaccctggattgcaaatttttatttccctgtaggagaattcagtcaaaccttgtaaactgtaacaactctcaggagcattggtaagaaacaatatcatctaacttcaggcattatttcctggtaaattaactacatgctctttgaaatcagccctttactaaatctaaaactgcagttttactcagatattcttatgtgagtgaaatcaaatgcatgtatgtgcatacatatgtaatataaataaatataagttttctttaggagttttcccaattcttctgagatgatttttctatccaaatacctttgtttctatgtcttaaggagttatagctttcggttgcatcttagtccattggcaagacttgtatttctgtaatttctgtaaaggtaaggtatctacttgggccacagatcaggtatctgtctgcctttgtggatgtttggcataaagcccctttattccacctaaattctcgatatttggggtatgattttatttctgtaaaaaaggatttaggcagggaggtgtcatctggattttatctgcccttaagagtaagtgttctttctcctctccctatctaaaatttccatgtgattccctcacactggcactaaagtgtgtcatctggttagagctcacatcagtgccctgctgctggtggaggttgcgggaggtgagctttagaaaagggcctgcagctcaacatacatgtcatggacacaatcgtattgtccccaactcatgaaaattcctgagaacagagcaaatcaaaaataatatgttaaaacaagaaagtttagtgaaacaaactctcggtattgttagaggctttattctaatccctacaacacagcacatgtattctcaacatctaacatatttaatttgcatttggattcctttagcatattgtcctattatataaagtttaatgaacaataaacacagctataaccaaatttcacagctatttctcagtgtggggtaagattttgcatttagttatatttggtttcctaggtaatatttgattgtggctctatttcctgaagctgcatctcttgtcacatggaatcttttggtggcggattctgccgaccgaggggaagccaggaaggagtaagttgctttgaaaccactgaagccatgatagtgaagaagacttcacagtccttgacagtctttgagctctccattgttgttctccaggcttgtatttctgaaatctactgtatgtactagttccagatcagtcttgcccaaataccatttttatcctgtcattcctctgctcgtgaaccttcaatgacctcttctcaatgtagtccaaaccctacacttggctttcaaggtcttccagaatctgtttttcaaaagctgtccctcgaaccacattttcttgaatattcatggctttctatattctaataaggtcaggtttctcgctgtcactagcacattctgtcgtcattatgctccatgcccttgcagctgtacttctttctccctggaaggcgctcttctctggatctatacccctttggggttcagcccaagtctcacctattttcccgagtcttctttggtcagttaaatccatactcatgccttatcccaaatcccactgcatttatattcagtgctgagagacactctggcttggcatctaaagggaattagcgtggacctgagagtaaaaggtcagttcaagttctggcttcttttctttctaatttttgtggcatttgtcaattaatagaaggtgatcttactatggaagtctcacaacagtctcagctttgttaacaaagattataaataatgggggcaaagcagagtattgggcctgggaaagagtttttgtaaagcttcaggtagaaccttatgttagaaatgtaaaacctcctctaaagaaaaatgttaccaataaataaagcaagtaggattttgagtagattatcatttttgttgtgtattcaccctgtttcctagagaatcaactttcctactttgtgcttactatagtttcctctagagtaggggctaactgtgtagaagaggttgtgtgtgggtcgtagggttactgggattagactattcaaatagcacaaatattctgtgtattctgatttcaaatgtaaacatattcctgattggaaatgtgtatatgtattttttatttttagttctggggtacatgtgcaggatgtacaggtttgttacataggtaaacatatactacggtggtttgctgcactatcagcctatcacctaggtattaagcccagcatccattaggtatttttcctaatgctctccctcctctgatcctatcccctgacaggccccagtgtgtgttgttcctctccctgtgtccacgtgttctctttgttcagctcccacttatgagtgagaatatgcagtgtttggtttactgttcctgggttagtttgctgagaataatggcttccagcttcatctacgtccctgcaaaggacatgatctcattcctttttatggctgcatagtattccgtggtgtatatgtatcacattttctttatccagtctctcgttgatgggcatgtgggttgattccctgtatttgctaatgtgaatagtgctgcaatgaacatacgcatgcatgtatctttgtaatagaatgacttatagtcctttgggtatatacccagtagtgggattgctgggtcaaacggtatttctggttctagatctttgaggaattgccacaccgtcttccacaatggttacacaatttacattcccaccaacagtgtaaacgtgttcctgtttctccacaaccttgccagcatctgttgtgttttgataagtccgtataatttaattagaaacctaagtaggttttggaggacctactacctttacttaaacatcctgaattttatttatttgtttattttagaattggggtcttgctctgtcaccaagactggagtgcagtggctattcacagctgtaatcatagtgtattacagcctcaagcttctgggctcaagcgatccttctgcctcagcctcccaagtagcttgaactacaggaacccatcacagtacccagtatatcctgaatttttaaggcagcctctccaagaacattctgaggtgttctggtgtctttagtaatcttatctcctaattttggttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttacaatgaaatatttacagtagataatttcacagtcactgctccctaattcaaaacgctttgagcctgaagctctaaggccaggccagcttgagtctgatactgatgtgctttaacatgaaacgtgagaccaggaagtggaagacccgtagccaaactctcatccttattcacagtaaatttcttgacagaagaaaccagggaactatggggtttctggtttattatctgagtggtctaatgcaggaattattgcctgccatggggagatgattgcagatcactctccggtggagtttgactgaacaagaagccacatcccaggtctcaggaataatgttattccacaccctccctgttactcaggggtgctctatgatgggctcagctgccgaacattaggggattcgaccaaaaccttaatcatggcgattttgataatcagttccaatgagcagaatcctgtgggctctgtgaaacccgtgaagctgatagtattgaaggaaatgaaatgtgataagtgtgattgcttgacatgccagaagggggttggtggagaaagaattcaaaaaagaaaatttagctatcttaaaaactggcacttctgagaataattatgtagggaatttgcactttcatactctaggtgtttctgagaacaaacacatcttaagaatttagttagaatatgtagataataaagatttaaactgattgccaagggtcctcacacaggaatgatttttcttttatagttaatttattaatttgagtaaaatgtgattcatttacttctgagcctttgcatggtgttcatataaatagtgttgataatttctttctttctttttttttagactgtatctcactttatcatgcagtggcttgatctcggctcactgcaaactccacctcctgggctcaagtgatcctctcacctcagcctcccgagtagctgggactacaggcacatgccaccatgtccagctactttggcatttttggtagagatgagtttcaccatattgcccaggcaggtctcaaactcttggatgcaagtgatgtgcctgccttggcctcccaaagtgctgggattacaggtgtgagctactccacccagccaatagtgtttgtaatttctgatgacaaatatttcatgctaaataagtagccgaccaggaatgaacaagtaattaccaacagtggggcacactgttgtttgatggtatatgttttcctaacatgaacaaactcccttacaacttcaacatctgtgccttaactaaaatctggacatgctgcattgagagagcatctcttggaagtctcctttagtgaaggatgcttttttcctaatgttttaaattcctggagtcagaccttgattctacaatcattcttcagtgatgtttcttcttttaaggtcacgtattttttatatgctgtcgccccgtcctcatcattagcatttattgaccttcaggatgtaaaaaatactctgagttcttcccttgtagccttcttctcactccatcctttgcattgtccttggtgacttaagttttcatgttgtattttttcctaataacctgatttcctcaaatacctggccacgtagcaaagggagtttctattgctggtactgcttcctaagttttcagttctcccataccttaaacctcctgacactactttctgtgtcaataatctcaaatgtttcactagcctccatgtggcagttggagtttctagtctagaatacaaatggtattcccactaatacgcaggagctcttgcctcatgacttgatacactatccaaattccaaagacattcccttgctcggtttcttggcccctgccttacagctagaaaaagtcatgtacttggcaattacttcctgtaaatccatatcctcttaccttagcaatgccctcagtatgttcttttttgtggccatctaagctttgtccctaaattgtgaccattttcttttctactcaataatatctcattttctacgttggtagttagtacttactcagtagaagttatctgatgagagtctttcttcatatttctttgtgtcaaaatgcatttttatgtttaaacatctcaaacctccctggcaattaagacattttgggacttttctccaaacataacattccatttaagtctgggactcactttcataaacccatgcacctgtgggaaaactctcttccccaacgtgccctaaactttattgatttgggcttaccttccttaccttgttcatctagatatgttcaatgggccttgtactgaatatttgtgtggtgtttacatgtttatacatgtttacctgtgtgtgactttttttttctaatttgaaccaggactatgtgattattttacttgtacatttcttagaacagtgtcggtcctcaaaaaaaacgagtgggtttcttactctctttcctttctttcactaaatatttcatcattgtagcactgatcttacacatatttgttaatttttctggctcattgtcaactgtgagttctacagggtaggtacaatgcctcgtttatttttatattcccggtctctgtatcaaacctacataggatttgcaggaaatgagccactgggagtttttgagcaagtgtgtgatatgcccaaagatatgccttagaaagattcctcctggcagagtgtgagaagcaggttgagagaaaatagtaagctttgttgagagaagattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggtaattttagggttagcctcaactttaaaaatagaatataagctgctacatacacatgggcacagccaattatagtagtcaaagtatagtagtcaaagaactggtgaaatggcaaacatttaagaaatttactccatttttaactttataagatttgattattattcctttatagccttagctttttttttgtttttacaattaaagatgtttttaagttaaaataatccacttatattagagcctctttttctattatccagacagcacatattattctatccattaaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaacttacagaatttgtgtcaaagaagttcatgtggcaaagacatcaggtgtatcaaatattttggtggttttgtttaaattcagagtgagaattaaccaagcatctacaatacgtacacctgctctgtattctaacccttttgttcatggcatgcacattaaaacacgtagctccacttcgctgcattgttgattgcagttgatgatgagggttgtcgtttctgtcaacttttagtattgaagagaagcctcatgtgtagtgatgttagggacagttcagccatgttacatacctagaattgtctctgaaaaaaaaaagtcatgaactttttttttttaaaggcaatagaaagcaatcaaccaaccaaacaaacaaacaaaaaaaaacaaaaagtctgggcgtggtggctcacacctgcaattccagcactttgggaggccaaggcaggcagatcacacggtcaggagatcgagaccatcctggctaacacggtgaaaccccgtctctactaaaaaataaagaaaattagccaggtgtggtggtgggcatctatagtcccagctacttgggaggctgaggcagaagaatggcgtgaacccgggaggcagagcttgcagtgagccgagatcatgccactgctctccagcctggatgacagagctagactccatctcaaaaaaaaaaaaaaaaaaaaaaagcagaaaaatgtgttgattacagagttaagggggagaaacttataaatcatggttatttaccacccctgagaaggtaggtacaaggttgactactacttacctcttaatcctatgattttctggttctgtggcttagaaggtttaagctctgtcaagtggctcaagcaggacagcccaaggtgactccaattctctgtgactttgttttcccatgtgggaagtaaaccctaccgctgtgttgtaaactgtttagatatccacataagaaggggttattcggtattttgggggggcttaagataaaagctatctccatttgagaaattagaaaaccatttctacaaatcaactctgttaaaccttgtcgccccaaatcaatttaggacaaaaagcagcagcacattacttttttaaaagcccaattcaattttaaagttttgaaaaatttcaagcaaacataaaggacagaaaatgttaaacatccttgtactcaccactcttaacaagcgtcaacattttgccacatttgctgaatactataacttacttttttgctttttaaagtttttattattgaacacagacaagtactatatgttaatatgtgcaatgtacaagaataatgaaatagtcatatgtctactacccaacttaagagttatagatttattttttaaagaaaaagtataattactttgagcttgccagcgtaagtttcctcctactctctccctgcaaaaaaaatagttgtgtacaaaataaaattcctggggttgacattcagatgaccccaatgaatctgattttttttcttttctttttttctctttgctttttttttttttttttgacagagtttcgctcttttgcctaggcaggagtgaagtgatgtaatctcagcttcctgcaacctccaccccttgggttaaactgattctcctgcctcagcctcccgagtagctgggattataggcgcccaccaccacacctggctaatttttgtatttttagtagagatggggtttcaccatcttggccaggctggtcttgaactcctgacctcatgatccacccgccttggcctcccaaagtgctaggattaaagacgtgagccaccacgcctggcctgaattttttttctgttgctcttcaagttagatggtttaagtaatgatgtttgccgggaagagatttgaggacctaaccgtgagatagtcctgccctgttcaggtctcccgtgtttcctcattagaccttccagcttattactggaaaagcattcttttctccatgttttaaacacctattgagtatgaatgttttaagtgcttattaaatactggttcataactctttgtaagagttaggggagaatcatcaatatctggaacaacaccattcttcatgatattggttttgagagccacgtgggcagagaaataaattctagaaaaaaagaaatggtaatctgacatgcagacttggattataaatatggtcaaaggtgtacttaaaaacaagatattttgcttcttggttagctttactgagaatccagggatcaagtaaaatcattgccattggtactgacggttgagagtcagtgcgatgctaaaccacaggaactccttacttctatgcatgattaaatccagttgtcaggtttgggcagaagagagccctccttttcctcaagtctatagggaggtgctgtgggggagttttctcattttccagaatatacagagcaaggatcatccatcataatcagacaggggtatttcatatcatccatttccagtgagaactgtggtaaaattctgtcctttttcccatttttggctgctgtgattgaaacccgtcttataaacagaaaagggtagtttgagttattttaaaaaataagaatccttcagtctctgttgcccattttctcctctatgaataatttctgcagacaggtgaccagttcaaccatctctctcggttacaaatgcctgtggttggtccacttccttcagccttggagtaaaataaaggcttcttttgcaagatcacgaaataattcagcaaatactgtgggactataaggtattcctgtgttgtcaccttttcttttgaagaatatagagaatatgcttttcttcctctaattcaaatacatagattccttatgcttgtataatgaaagaataagggctctgatacatacatatcattgaacaactattatcagtattaggcaatttagaaaacaaaaaataagacttcagaatttatatcagctccttcaatacttcatttagctggatccatttaaatatttcattttttagcctatgttgtagtagattgcttgattggtccaaggtagtctctaaatccaattagagaaaatgaaattcaggaagcacatcactgtagattttggtacagtgacttgagtatataattgccatctctttctatgttagctcaggggtgggttttgtgccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggtaactggcccacacaccacaaagcgaggaagtaggaagctggaattcacatccaggtttgtctgttagaagcccatccccttgacctttctgccatattatctttccttatgctgtggcacaaaaaaagaattgtgaccataccatcttcccagagagggattagacaaagtccagagaacgtctagatggtcaggaactctagtcatggcgatgctagttactataagaggatacttggcaaacagcattgcacccagatggtgcgcaacccacacgtctctatttacgtagaggtctcaagtgtttgtattaacaggtttggaggataataaaaggagttgttgtttgttctttctttgtacgtctgaaattaatttttagcataaatttaaaaggggagtttgtaaattcactagacactgagagactggagatccaagcaaacatttgtctgttgagtttaaaaagatctggtgtaaaagtgattgttttctattttgcccactaggtggcgctttggtctcacaggttccttttaatgggctggatttccccgcccccccacctccccccaacccacctccccccaaccccaccccatacctagatgttggtccaggaaaaaaaaaaaaaaaaaacaattcaagactgattaagaggactatgtcagttgagtttgttcagtttgggttttctctatcattatccatgttgataacaaagataattaaacttatttgaaaattttggacactcctttttcaaccttcttgcaataaactgtattcacttattttggaaaaaagcatcaataaatggaactagtgagttatcttctcagcatgtctccacaggctacacttacaacagtctttcctcctacagagcggggcaagtcataggaagtgactaaaaccatgtcatttgggtgttcatattaagcacactggctatgagatcgccccggaatgtatacacagcccaacatgtcattttcttaacaccttaacatcagtgtggacaaaaacaataaggaacaatgttttaaacatgtttacatcaaagaggactggggtcataaggaagcagttcgatgggagaataaataacattattccaaattcaataaaactgatcagtcattctacaaatgtacactgatttgactcattccattaccatgcaagaattttatttgttgactgttgtgaagacattcctgtcatcaagaaggaattttctaaaattataacctgagatagtagtaagtgatagaaaaattcactaaatggcttttccatgaaataatatttatttatacctacttctgaatacctactatgtgctgagcaggtgcagggtgatgtgaaacatatattaaatcccttaaggagcctacagacaaagattaagagatggctgaaagatagtgtatccaaggtcacgttggcacagattactgaagtgagtggggtggcctggaagaacattaagtggacatttaagatggaacagctaataagacaaaggtaaaatgagtctagaagaatgactagactgagaagagaggaaaggaaagaggcagaaatagtagaatgtagaaaagctttaggcccatggtgattatggagaattgcagaagtccagtaatctagagcataataatgcatatgtggaaagagtgggaaattggggccataggtagaagccagaatcagggactttgagtactaaattgagcatgatctattttctagaaggtataggagagactttgaagaaggctgtcacttgctccccacgtaaccctctaagaaggcatgccattcacttccactttccagaagacacaggtgtgtttccccagaagaccatctggatccagaatctgtgcagactgaccatctatcatggtctttccttgtgggaattttaagtcttgactttccttctggagctttccatgcgaccgaggaagtgattatacaatagcagatgagatccttggtataattaaggattgcttgtcactttcaacatttccccccatcaaaccgtggacagagaggccttggaagggtttagttctgctaccatactcatttaaccctgctaagcatattttcttcagcattttgcaagcagaaatttatagtaatgttttttgacactaactctgagtcctgcattctctgcctgacttgctgtatttgaaggtggtagcgaaacacatggtgtatgtgtatgtatgaagtaggaggcatggtggtacagatttagctatgggacttttcagctttgcctgtatgaaattcatttactaagtatatgtaagtgaaattccagcaattcagaaagggttctggaattgcttaaagcccatcactgcttgtgaattcttcccacattaaaatgttatcttacagaaggtcaaaatgtctttcctgcatgaatataataatgacttacaccttagactgtaaccattgtgaatttattctatgtgtatctatctctggttttctttgttggagtggcaagatttaaagcaggccaattttatgcctcattctatgtgcaccaaaactacttacatgatattggttttcagtgcctgctacaacaaaaacaatatcccagtaacagcccactttactttctgtgggtagacaatgccctcacaggggttattaacttctcccagagaagcttttgtctttgcaatcctgaatgcatttctcttcatattagattttaccagtcaccttgttgattatgaaatgctaagtcagggtctttattagactgactttgctttccctttaataattcaggtaattattatatttacagaatttgcctattttttgaaatcaacactttgttaatcaccagacccatgacaatctataagtagccactttacgtggcttatagatctaaagtgaatgttggttttcacacattcattcataactattatttttactgatatattaggcaaaatataagattcatttatgagtttgttcatcagctagttataaaattcctgttgcatggtaagtgctgtctgtattgggcaacagagataaaatgggaaacaaaacaaaaatcttccctactgtcatggggtttacaacacctggacttctcaaaggacactgaatcaaaggttcttctctaagactttgtatgaagtcttagtcagaatcaaagatggttggcaccatcattcactaaagtggcctgagaagtaaaaaacctctgtatggcaaggagcagtgggacctctctttttttaaacttttattttaggttcaggggtacatgtgcaggtttcttacttaggtaaattgcgtgtcacagggatttggcatacagattattttgttagccagataataaacatagtacccaatagcttttcaatcctcaccctcctcccaacctccaccctcaagaaagccatagttcctgtcattcccttctttgtatctctatgtactcaatgcttagctcccattttttaagtgagaacatgcagtattgggttttcttttcttgtgttagttcacttagcataatagcctctaactccattcatgttgctgcagacatgatctcattctttttatggctgcgtagtattccatggcatatatgtatcacattttctttatccagtctactattgatgggcatttaggttgattccatgtctttgctattgtgaatagtgctgcaatgaatgtatgtgtgcatgtgtcttcatggtagaataatttatatttctttcagtatatatccaataatgggattgctggctggaatagtaattctgttttaagttctttgagaaactgccacaaccattggtggggagctagtgcagttgtttggaggtaagaaaatactctggcttgttgagtttccagagttcttgtgaaggttctttctcatttgtgtaggtggatgttccttcaatctttgaagttgctgtcccttggatggatttttgttgctttcatcttctttgatgcccttgggggcttgattgtggtataaggtaggttcagtcaactcatttaagttcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttggtggggggtttgtttacctctacaattgcgtaactgaatgaccctgagcaaacggtttaacctttctataattaacaggatttcttcttacatccaagccctccctgctgctctgacccagctgtgggtgatagatcattttcaattctgcaaaccacggctgagaaagatggcagtgtgtaaggctcctctgatagattaggaatcatggaaggaagggacattggctgctagctatggctgctcagacagacaacccatgggtcttggttctctctagtggatctctacagggcttccttaaagtcagaggctggctttgccttaagattcttgagcatgagtagaactcccaacccaaagtaaagagagcaaaatccagagaaggacttttctccattctaaggcccgcctcccaagtccttaatttctgttttaaggtctggctcatctcaagaagaatgacacttgaaattatgacacagaaagaccctgtcttctacccaaaggggtgtggcattgtctggtgatgtgggctgcttaagcacgtttaaacacagtagtccaacaccagtaaatgataccctacagcagggagatgtttccttatggttctgttgaattctctggcagaatgtgaattctatccaacctcaagatttgttgcttatctagtacgattggctgccttgtccacaacatcctaaaggccctctgctcttttctcttaaagggcactctaaagtgccttcccagtgtgtaggaacaggactgaaagggccgtttttcttggctgctggtgactttccaaagcaagtgtctttcccttctcaccttgtccatggccccttgtgccctttatttgctctttctgcctgatgtagcagccacaagctgagagggctttctgtgaagtggcaggacctgacataagcagctttgtgcagtgggaaggaaatgtttatgttattatacacctgggacctctaagtccacaaggttcactttttattgtacacctgggccatccttttctacacttctggctcaatttgtttttggtttggtttagaaggttttcttctccctaaaatctcccttaagtcttaggccctttttatgcagaaatgcctgatctccaggctcaaaaaaagcatcttgtgcaagggaaatcgttttagatttaggaaacctcttacacagtaaatttgaattttcaaggtgactgaaaacttaaattcaacaaatatttttatccacctagtttatactcaaagtgtgctagatgcaagggatagcacggtggtaacgatagacatggtcccagctctagtagagcctgtgatctggtggagaaacaggcactaaatcaatagctacaagagtgatgaatgttacaaaagaagagattccagatgctacaggtacatagagcaggaggatttaacctaatctaggggatttggggagttttcatttaactctgctgttgtctaactgaatgaccctgagcaaatgttttaacctttctataattaatagcatttcttcttactcgccaagctctccctgctccagccaaggctcctgggtctatgaactgtaacgtcaagagagaatactgtcaacaacagtaagcctgactgcagagagtaaacacaaggagaaaatggccttggaaccacagagtagactccagagtatcaggaccatttggaggagagaatggggaaaaggctcgtgggcagacagcagtaaaccctgtgatagacattccatctgtccattagtataaacctggcacttagcccagtgatcctcaaatatttgtggaatgaatgaaatgcaaagcaatgtcaatttctgtccacagctgcttgactcttaaggttagtgttgatccctttggggaatataggcgagcagatgaccccatacattggctaactatgaattgagtggatccaatgaccactgccctccttgtgcagatcgccccacggatcactggctgtgtgtgcccatctacccctttctacaagaacttttctagccctgccaagcaactggttctgttcatgatgctgtggggttaccacaaaatacgtaatagctccattcacttagaaagactcatcctagataagaattatcctgcctcatctacccctccctcatagtttttcatctcatccattccctcctcctccccatgccgttatcaactttatacattggaccccatcctgggactcatactctgctaatcctgttcttggagttagggaggttattcaagtggcttggagaggagatggggaaagtcactctagacaagaaacattcagactctacctaggactaaggtcaatcacaatactccaagcattactggagcaaattataaccgtagtcgggtcagcttgcacattctatgctatatatataatgagggagatatagttttcatggcaggttctctgttaacaatgggcaaagactttggggattgatgtctgcagggaaaggatagaaggaactgaaacttctctccacagaagcacctgaaacccagtctgtgggcctttcgtgtcagaatctagtgaaatgattttgacaccacacacggcaaatctgtgcatgtttttctgtaacaaagaactgagaaaatcaggagtccttatcaaagggaacctttgatgaccctctggtggtcaccttttatagtgaaaatgtttggtaaatagagaaaaaggggccaggcatggtggctcatgactgtaatcctcgcactttgggaggctgaggcgggaggatcacctgaggtcaggagttcaagaccagcctggctaacatggtgaaaccccatctctactaaaaatacaaaaattagctgtgcatggtggtaggcacctgaaatcccagctactcgggaggctgaggcagaacagttgcttgaacctgggagacgaaggttgtagtgagccaagatcatgccacggcactccagcctgggtgacaagagcaaaactctgtctcaaaaaaaaaaaaaaaaaaaaaaaaaaaaaaaaaaaagagagagagcaagaagagtgaaagttataaatgaaaacaataaaaaaaaatccaagaaactcaaggaacctttgatgggaaaactgggtttttctctgacctcactactttcccttaaccatcatagccctgccacttctacatgcattggaggaagtgatttctccactttctgagatcctagaggacttaatttgcatctctatgataagaattttaccattatgatctttttattctcatctgttttattgctacaggattatgggctcctctggacagtgttttattcatcttcctctctcactctcctttacagagtaggcccctaataaatatatgcagaatgaataagcaaaatcaataattaatagatagcaaatacattcatgctgacttctatgattctttttctcttttctgtcttaggtttttaaaagtagtacaataaacctattgctagtgtctcaatatttgcctccaagagaataaattgtccttttaagaaacaaaactatctttatctaaatcaaggctgaaaaagatatctaggtacttccaagttactgagcacccctgccctggctttcaggaattacagctgctgattaaacatctgtttccctgccttttctctacttattatccttctctacttattcatccttcaagactacttgaatttttatcttcttactcagtaaaggctttctctgtctaccaaagctggaaacgtttttttcttttctgatatctagcatgactcattactattcccattcattcagtacagatgatgtagggacaagcactttggagacagtaccttggttcaagtcctactgtgctactcagtgatggtcagtgaccctttgatcttgagtttcctcgtgatgttgataaactcctgtgttgggatgactggtctagagggtgagatgaggatatgcatagaagatgcctattccaacacctggtgcttattgagggctccattaaaggcaactgctcttattatttgcatatatcttatgccatgctctagattgtaaattcaagtattatgtatctttccaaataacagcatctgacttcttgctttcagtgagagagatagtcaataaataaacatattatatcatgaaagatagtgataagggctatgaagacaaataaagcagggtaaggagagaaagaaaagggccagggataatgtaattgaggaagacttctgggagaaaggtgcacttgaatagagattgaatgaagtgaggaaaagaattatgtccgtgctcgggtggaagcaatgcacttgataggtacaggaaaggaaactccaaaaggtgtagaagaattacagcatcctagtgacacagaggcccatggagtggagttttgcaaggaggaaagtaatcctcagtttcaaatgcagttgagagggctgggagggcaactgcagagaacacttcctggattgagtaagtaagagagcaagaccaatgacagtggattggtgagaacagcagacttggggatgccctgagtaatccaatgagggaaaccaagacaggactgtaaccagagagagaaatggattgaaaggggagttagactttcatctgaaagacttggttatgtgtctggtagagaaaaaaagaaaagttaaaaatttaggagagagataataactgacagcatggtcttgaagaaggcaggaactgatggtttggtcttaagaaaagaagtgataccaccacatgcagggtaaagagggaaatactggatatggataaggctagggatggcttcaaggttgctttcttttcctttcccttcccttcccttcccttcccttcccttcccttcccttcccttcccttcccttcccttcccttccctcccctcccctcccctcccctcccctcccctcccctcccctcccctcccctcccctcccctcccctcccctccccttcccttcccttctagatggatttccgctcttgttgcctaggctggagtgcaatggctcgatcttgtctcaccgcaacctccgcttcccaggttcaagcgattctcctgcctcagcctcccaagtagctgggattacaggcatgtgccaccacgcctggctatttttttttttttaatagagatggggtttctccttgttggtcaggctggtcttgaattctcaacctcaggtgatccacctgcctctgcctcccaaagtgctgggattacaggtgtgagccaccacgcctggccgacttcaaggtttctaattaaatatatggcagagtttgcagctgagactgcgggtcagggtggtgagcttgattagaggggtggaagtttaagctagaatgaataagaaaagaaacccatcaaggaacatttaaaaaacaaagtttgttctctttgatcttggggaaagtaagtcatgtactccatttagtacaaataacaacccctaaccacattgtccatattgcagggtttcctaagttcacaccaatgaaccaatctctgtttatgaaatgcgctctgcctgtgcttgcattttacacacacacacacacacacacacacacacacaccactctacatctttgccaattcataaccaatcacctcaattatggagggtgatagtcttttctttctttaattaatgagtttccagtttagatgtgtgatctttacacagtactatttaatactgtgcagtttagattcaggtaataccacagtggcagttatttctagcagcaggtgtggttggttacttttatagacatatgctcactgtgatccagggactatgttggacacttgatacctatgttatcatattgaaaatccttacaaccatactgtaagctgactgatggggaaactgaaatgtattgatattaaggaatttgctcagggtcgcctggcttgttaaggtaaactttgaggttgcaggtgcgggtctgggaccttaaacatcatcatgtcacctagctacagcaagagccagcagaacaatactcttcagcctggttttgatatggaagatgctcttcagcttcatgctggcttgaatttcctttgcagtgaagggagaggagaaagtgcattttaataagcttcaattaaattaatttcattttacttcttttgatgtatggtctcttcaaaaaatccaattctactgatgtttattaagtgcctctacttacttggagagtgccaggcacttcaggggatctatggatgagtgtgattcagccctgcttcaagagctcacaatctagtggagaggatgggagtgtgcaatttgctctaatactagattgaatgtaataagtaccatcagaagtggcccaaactgtggttttttaattctgaaatgcaaggttatgtgactaattagaaaattggcttggcagtgcctaaacaccggaagcatcacacaatagaactcttataaagggtctttatttcaaacatgattatgcatttgttcaaatctatggcatacaatgagtgaagaatgtattgatggtggtgacatcatctgccaggctgtgaaggtcaacagtgccagcccaagttgtggcatagtgttgggtgatttaaaactcaggggcaagacagtaaactcacaacaatcccagtggtggtgcatgacctgcagctgttcttggttctttgtgtgttttggcaagcaacagctgttcaagacattgaactgcaattgcacaaaaatatatgttatgtgaagttgttggtttttcttcttttattactatagggtgcttttttgaagttaacttcggaaatattgtgaactcagaataggtcaagtcctatatattccagctaaacaattgtttaatacatttttaaggagatttaaaagtagggcagtagatactgccataaaattcttttccaggtttactgcaagcttttggaagaaagaaataggagctagagaacatgagctagtacaatgtaccatgtgcaaataggaatttaataaatgcttcccaattcttttttttaaattggtctcctaggtgtgttaggttctgtaatagtcacttccaaaatacacagctgaaaaaagcattgcttttgtcttctaaggttttatatctaaatagaaaggctggggaaatggtccactgacaggtcaaaagcaagatttctagtgtcatattattgggaacacacacgaagccagaaaatccatcatttcataacttttgtagcacttcacactattctaccaccacatagatgtttgcttccatatttgtctgaacatccttgcattttctttgccacactcccctgctgcaatcagtccatgcctccctgatggattggttgcagcagcatttggtgttgcttggatgaggtgatggatgcttctctctcttcttcagctacttggagccaaaatacaaaagtgctggttaaaaggtgattaatcttccctaatggttttgtgcattgcaaacaggactgcagccaccatgtcttcattagccttaatcagggcccacattacctcagatcaggtaatcggttatttattatagaacagcaggcaaaggccttttgagcaagtgtcaactgtataaagtctatttggaaaggaaaaatagtggggttccagttgccaagcatccatagggaaggaattaaagctggagtgtatttctgggcacctctcctgctaagcactttggttgatggagggcagcgggtggctttgaggtcatcaggatggacactcagtaacagccctttgccttttttttttttttttaacttcttttttgcttccagggtgacattatctgggtctagggactgaaacagtttgggaaatgttgtcttctgaaaatggaagatggatttttagtatctttgggggtttggtgtacttcttaaaatatgagtttagaacttgctgtatgcccagtaatattcagggtactggggatacagagatgagcacaacagaccaagctccaagcttttgaagcttacattgaatggaaaagacaggtaataagcaagtaaacacatgcaatagaataaaatattagcactttctgaaaaaaagcaaagcaggtaaggaaagaaagagtggggcagggactgatcagggaagtcttccctgaggaaaaaacatttgtgttgggattaagtgaagggaggtgtattagtccattctcacactgctataaagaaatacctgggactgggtactttaaaaagaaaagaggtttaattgactcacagttctgcattgctgggaaagcctcaggaaacttacaatcatggtggaaggtgaaggggaagaaaggcatcttcttcacaaggcgacaggaaggagaagtgccgagcaaaggggaaaggccccttagaaaaccatcagatctcaagagaactcactgtcacaagaacagcatggggtaactggccccatgattcagttacctcccatcaggttcctcccacaacacatggggattagggaactacaattcaaaatgagatttggatggggatgcagccaaaccattatcaggaggggtgcccagcattgtaagaagggccttctgtgcagagggaacagccagtgcagaattcattcttcaagtggctatgttccttttatttattttatattttgcacttcctaagaatcattccatggaatcaatccattccatcccttccataaagtacaagcaaagttaaacgagctgaagtaggtgaatcactagaacggtgtctggcatatcattcatgttcaaaaaaaatgtgagctgcttcctttcaatgtgcaactcaagaaaatgacttgccatccattcttacatacagagggtggctaccatttgccactgaaacaccatattctataacttcaggccatcaatgggaagcatcttccttttgcttccctctctcctttctctctttttttcttctcacctgtgtgctgaaacacaagtgcctcaaattcaggtttttaaataaataaaattcaataaaatcaaattcaggtttttaaataaataaaataaatgtaatctgcagatcacagagtgaacagctgatgactctgtgataacatcatatcacatccacatattccataccatgatccttaaagaatacatgcacacacagaacagtgggaacagctgaattaggtattaaagtggagtataaatagaaatgggtaagttttgtgggtagctgagaatttagagcatttaggagttcagaacatcattttagtgcaggaatgttggtctttcttgctaggatctgtagagacacatgataatgatggcctttcagggcttggtaaaacattgtaatctgtataatattgtgattatctccaaagctatccttaaaatgtttggggccctaacatcagtgttcaaaatcccaaaatattattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttcttttcatagtctttatcctttcaaatctagactgctgttcttttctgttggtcctccagactccaaataccttccagtatcagctagtcttatgcactgtgattggatagttaaatactactttgacacaaggctgccatcttactgttggaactctccactgttcttatagtaatcatcaggctctgaacactggcttcccagccctgtataatctcccccactttatttatccaaacttatttcagcagcatggctgaagtcactatccatggaactcactgcgtgtgttcccccgataccttgtctcaaactgtatgccctactaaaagggcctccaccttttctttacattctaaaaggtccagatcaatttttccctctaccgtgaaatttattttcccttctcctggcatattgatctttccctgtgaacactttctgtaaacttgaaaggtctataaaatggtcctttttatatagtctttcaatagaaacattttatcttacaaaagatgccccttactgaaaatggattattttctttggcgatgggtgactgttcagctgaaactaacagaaaacacaacaaatgttgacttaaccagttagaggttgaagacattaagtaagaaaaagttgagaagtatgctcgccagggtgaggcagctgtttaacgatgccatttgggagccactctcttctatctttctgtttcatcatccttgatgtatatgctttcagcctccagtttgttgcctcttagtcacagtatagttgctgcacctccaggcaagaggaatggaacagcagaagtccaggtatgtctcatcggtcagcattggtcagaattacataacatgttacccctagctgcaagggaagctaggaaattgagttttgagcttttaagcttgtatagagaaagtaggactggaaaaatgtgctcaagaactgatcttaagtaaataagcctatagtataaggcgcagcaaagcttaatgaatagatttttatattcatataatgctccattcttttatgatgggaaagatattagagtgaagaaaatggaatactggagtcagattcaattgttactgaatattggcactgtcctcttgtagtcttgagtaagtgactgttctttctgagacagatttcctcatctaaacatttggcttaataataacactgcctcttagagttactgtgatgattaaaagaggcgatgcctgcagcctatgatgtggcacatgtcaattctttttccctcttccatttgaggccctggtaggtgtggagaaaatcctaaaaacaataaaacaaaccaacaaacaaaccagaaaaattgaatcaatgaagacaatatctgccaccagctagtcccataaactcatttcaataaggaaaaaatatcaccccagtaacggaactgcaggagtgttttagatttatttatcttgtaattgagtggaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccagaatcatgcgtgatcccagaaaaaaaagtatatatatatataactattataattttatatatatatatatatatatatatatatatatatatatatatatatatatatatcatagcacattcttagcctacccacctcccactaccccaaaaagcaggacaacattttccatatattctattgaagttttttttttttttaaaacttgttggcacagaagcctatatctgtagatattttaaaaactttacttatatctatttgaaatgtgttaaaaagccatatattctttttttttcttttgataaaaggaaaagcaacaccctaccagatgttgggaggaatagtaagcaagtgattcaatcagatttctcctatggggacatagactctctcggtcaatgtcacagaatgaaatagtctcagattcacccagcagtgagttattccatctggttgtggcaattaggagctgaagatgacgggaagttaaatgactatctttatgaaacaaagcaaaatagaaaagggaacagctgggggactggatggcttggggatgcagaattggatctagaataaagaatctgttacttcgagttgctagttataatgccagtgcaggttaatacaaattgaaggttgctgctgtgtgctagcagttagctgtcgcttgcctgaaatatgaccataacatttacagtactgtctggattgaggtctctagaatgtaatgtcctttttacttaagggccaagccaccagattaactacatagacagggagtcattgaacttcagctctggaaaggatgttgttaccaagttcagtttgtgaattgccaggaatgttatgtgtcttttctttgcatgtgttatagtctaaaaagatgcatagcttttatcaaatccaaaggaaagaatgtgaatccaccagtccttttctaccctcttcccctcttcccccacaaaatgtgaagaacttgctttagaccttgtctttggagttgggtagtctagaacataagcttttggcttactgcttactagctgtgtggccttgggcaagttatttaatctctactagatttattttttctaatttatacaatggggatgataatattgtttatcctattccataatgttttatgaggaaaatttgaaataatatatgtaaatcgttttactgtaacatgtacgaaggatccaataaatattggctcttattattatgttgaggtatgctgaaagttagtggcagaaacaggaccagaacattgatacccaactcactactctggcctttggaaaacatggtgagcctatctctcttcttatttgtcacacccttcatgttttggcaggactcaagagctaacataaggtactgaaatcaaataattacttctaccattacagcgctaagtggtctacttctgcattttgagctctttttcagaattctttaaacatcttatctgcactgcagtctggaaagggaaatcacagagagaagggaaatcatactttggctttccaacaccctctacccaagttgcccaagacaaaactgtgagcaaggttaaacgtctgactcattagtaagaggaagtctttttaggcagttcctctgttgaatagataaagtggatcaaacaaaagagatgacagattagaaactgtctggtggctaatgtactgtttactgcagtataaatgactggtgtttgggaaatgacagatgagagagaatacaaatgtggacgtaaataatttccaggtttctacagtggaggagagtcatggttggttaggatgttgacagggaagggggaagtcattggttggagtttcagggaaatgagaagagcatggagaggacttttgaattaatccattgatccacgagttaccatagcctccgtgctgcatacagaaggtaccatgaaggggtatagttcttttgctcttttctcactgcctgatccattctaaatgtaactcttgttccagaccaagtgcagaaatctttacagagagaaagcattgggatggggatgaggctatgctcagccagtctgggagatctctaggggaaaatgtcataggaaaaaatagtgataaatatgcttaaaagaaggcaaggaagaaagcaaggaaggaagaaataaagaaaaagagagagaggaagaaagagagaatgaaaagaagggggttgggagggaggaaataaaagaaaaaagaatggaaaggaagaaaggaaagagagaggaaatatggtatatcagttattctgcatgatatgtttgagttgagtttgtggtggttacttgccccagggtatcaaaagaagtctccaattaatttgtagccagtgtaaccatatagcatctatttgcttagttttcaataataataatactggttctgattaaataaagcatattgtcaaacttattatttgcaaacatattactgttgtaactggtaattgctcagatctctttcggttcctgccccgacacccaaaagtcaagagggtggaaggtgaccctttctaagactttgacatggaaattctttattctgtttcaggaatggcaaattccagtttacagatggatggaaaagatttcttccttgtgataatagaatgcaggacagtatttctcaatagccatgccaatgacattttttgactggttaattctttgaggggattgtactatgcattataggatatttaacagcatccctagcctctacacagtagctgccagtagtagcctccccaacactaattgtcacaataaaaatatctccagatgttgccaaataccccttgtagaggcccaaaaatgccccttggagagggctataattgacatttttgaccggataattctttggggcaattgtatggtgcattatggtttgtttgtttgtttgtttatttatttatttataaaacagggactcatttttttcacccaggcctgagtgcattggcatgatctcagttcactgcaacctctgcctctgaggcttaattgatcctactgtcttagcccccccaagtagctgggactacaggcatgaccactgtgcccgtctaattttttttcttctttttttttttctttctttctttctttttttttttttgtagaaacagggtttcaccatgttgctcaagctggtcttgaactcctgagctcaagcgacccacctgcctcagcctcccaaagaatagaattgcaggtgtgagccaccacgcctggcccattatagaacatttagcagcattcttagcctctacatagtagatgccagtagtagcccccccaacataattgtcacaataaaaaaatctctaaacattgccaaatgtcttttggagagggccacaattgttcccagttgagaatcacttcttcaggatagactgttgttaaaccattgattcagattcccagggaaagactggacactcagcagccgagcatcctgctgacccccagaaccctgccttgacacctgctcacaaacccctcctctccaccctcaagggcaaggtgtaatttagctgcagccttttcccaaatgcctgtagcttctacaattcaatcttttttatttgtaagtatctttgcagttttctactttcaaaagactcttagtgatttctaatacctcaaattgtacaggtacatggctttttgtctctttctctgtgtctttttttttttttttttttttttagcttttcattgtagaggttcctactttttattttttctttccatgtttattgcttttgtgtctctgtcttcctgatttcattttggtgtggaaactgtctttctctgctattatcaatatcttactacctagatctcaatttcattttatggtttagccttttggtgtttatctccccagtcgctatcatccttttaatgactatttgtgtttctgggtcttttttcgtgtggcagcttgtcttttggactgcctctctctgtttgtatctttccagctattttttatagtctcctcctacttttggagaatagcgatatgttgttatgacatttctatttgtgactgcctttttcctctattgacttcccttcccctttctgcctttcttttgaaaatggcccatctggattaagtttctatcaagatctctttctataagcaggatttttctcaggtatgtaatggaaaccttttacttctgttgaatggtaatcctaaggggaggtcagggaatggacttttcagttaactgctcagaggcaattgtttgttttactttatataatcgaacttttataaaacttagaatattaaatccagcaaggttaaatatttagccttttgttaactttgtaaaataaaaatagaacttaaatgattcattataaagcaattatcttagaaaatgaataggtaacacattattagaatcaatttgttctcaaagctatgagaaataaaatcaataatttttagagatagataaagtgttttaggtaatgtttgggaataagaaactataagagtaggatttggctatttgcaaagtacctgacttttcccttggttcctaaagaatttcgaaacaaaatgagggcactataaggttcacaaggactgaaaactatttgatcttctcatttttggaagaaagtgagaatcgtaatatacttgcgaaacagattggattccatctggtgtagccaaattaatccttctttaatgattgtttatattgtgtatccaaaatcaaactcagtatcaagagttaattacaatttataatcattttggctcaacaaaacaagagggaattgtaaacagtaaagtttattttatagtataaacatgttaaaaacatggatcttcattggaccatatgtaaattaatcaaattatctccagtttttgttgttgttgtctgtttgtttaaacgtggtgcaggaaaaagcaatggctgctgagactgcagaggtttgtgaagaagtctgttaggttttctgaacattcctcccctccgaccaaaaaaataacccaaccggactaagacaaaaaactgagaaaaccaggatggaaatttgacagaggtgtaggaactaaacaaggaaagggaatgtttctcttctctctagtgcaggataaatttcatcagttccctgtctgaacctcattaaccttaataatacactatcaaaaagtcaactctatgcaattagtatttaaaggtacttgatattttaggtgggaaatttattttctctgaaaaatcacacatgcctccaacaacttgaagcttgctaaaatttatagcaataacattgaattcaattacattcaatcaaattccaggcatcaagtcgttattaaacatttacctctatggtcattgtgctatggttgggaataagaataatactaaggcaagatcttctcctttacaaagctctcagctgattaggaatctcataaattgtcaaatgtcactgtttcagctaacaatgtttctaccataaacagaactgactcaaaggggcaaaaagtaaataaagtacatgacatgggagcatactctcacctgagccttagagaggaaactgacatctgtcaattcacttgttctgttaattccactttgatatttcttaaatatatccactcactagggctaagccacaccataactgacttctaggcattcatctttcttccacttaaattcattctccaccttgcagctatttagttagttcttctagcaatacattggttaaaactagtcaatgacttttcatttctttcaggataaaatgcagtatagtatgcagtggtaggaaattaagcactagaatttgtgtttaaatcctaatttcctctcttatctatctctttgccctggagcaagtaattttactgctctatggttcagttattttatctgtgaaacagggataataacatcacttacttcatagggttactagtaggaaaaattagttaataccagttaagatgatttgtagagaaatggcaccttcaattaatgttaactgttactattgttgccacctctagacactcatcccttcgcactgcccttttctcatttttccctggattgttttgagtttcttagaacgtgtacatgctgttccctttgtccccatcactagactgactcctacttgactttcaggacttctgactttttcttcctccaggaatcatcttctaccactcctctgcatggcaggttagatgcccctcttaaatgcagggttaacctctatcgtacatttcacaccttgtatttacttgtttgcttccctattcttccttctacaatgcatacactttgagggcagaaactcagctctgtttgtctttgcagctctgtcacctggcacagtacctggttcattctctgcagaatgaggaaacctcaagcatccactgaagggaacagtgtagcatagctcatattaccaaatatctgcatgttagaggcttatgtgtttatgagtaggcaggtgtcttcatggaactctggtatcttccagatgttcataggtatatctggaacgatgagtatctggccaagtaatatatggaatcaggaatatgtctctcctaaagagttatattttgatcaacctcactcttactgcagtgggcaagcaggtacaacctagagttttccaaaccgttcagattatgaaacctgtcgttagtaatatattggaaaactcaattatagtgccctaaagagctataataagaaacacagtttggaaaatacaagtctgagttagtaaccaagatgtctttttttcctcttgattctaggattatttcaggaggttgtgagagacacaatgaggccttcagctctgggtagactagtttcagccggagctcttaatgggcatcaaccatcacaagttgaagccattcagggatgagaattcttttagctattagaacctgtctccatataaatatttctacctttctcctccagtggtattctctgagcagaggagatgggttgcatagtggccttaaaaggcacagccccaaatttcactggttatgtggacataatatgactttaggatttcttatcacccacttcaaaaaccccagggtcacttaattaaaatgactgattcctggagcctcaacatgtgccttctaaatcagacagtctatgaatgtgagactaaagccaaagtttgtactgagttctcctgtgactcttatgctccctcatgtttaagattctaccctgagtagaggccacttcaaaaatagaaactttttaatagttctctgtttacaaggtcaattctgttaagccataaaccatcccatttggaattagtactataattatggttcttatttcttacacacacacacacacacacacacacacaggttttttggaaaaaaaacatgttaagagaagacatttaaaagtttaaagaacttagatgttttattttgtgagaagaacaattttggggcaagtcgcttaactgtctgagccccgttgtaccatctgggaaataggaaaagtggcatctgcccttgctccgcacttgggatgggagagtcaaatgagaaagactgaaagcaggtgtaaaatctaaagtactaggaaaaacaaggtgttatgatgtcttgataaacatttggtaagataggagtcttgttacacataataacatttttctgagtaatctagtttggtttatttttctgtggggtttaagagtacattttgataactgagagtttaaaacaataatttcagatgtattaaaaattgtacgtgattattagaagtgacgaaaacttctgggattatataaaattgagttttatacaacattctctttgactctaacaagagttaaatgttaggaatcattgatgtaaactattcttaaatgattccacattccaagcaaatgctctggagaacaaataggagaatcatctgtgagattaactttttactgatgccatgtggagtaagattatcgaagcatcttacatttaagaattttacctcagacttaaatagcacgttaaataaaacaggcagaactaacaaatcctgatatcaactttaatttcaactttagctcttttacacttttataaggccctttcctcttataaatgtaaacctattttttaaatggaagctaatttgttaagtccattctatcagaggtaaattgaaaaatgccagcaggcaagataaatttgacagaaaataggtaaaatcaaagttttattcatgtacagtggttaagaatgaagatattaagataaattattttaagtgaggactgtccttttaataggcctcactctatagccttgtctcatttttcattttcacaaggttcttgatgtattcttttcattatataaaacgtgccatatttggtcttttcatgaaatgtatctgatattctcctttgacagccattcacgtgaaaagaaaaggtcctatttctgtccatcacctacatgcacatattcatagaaatcatagatttttggtaaaatatgctatatacttatacagcatcttaatctcagaaacccaaagggtttagatccataactgtaccatatttcctttctgtatgttgagagatacacatggtcaaatttcctaaaacctgaatctaactcaatctaaattatatgatttccgtttctacacagtggaacaagtgtgtgtgaaataaaatcaccagcccagaggcattcacccaaataaatcttggagattttctgcaacatttcatccctctacttctatatctaagtattgctacttctagttggatgtaaaatgcatccttctcaatttatttttgtttgtgggggatggatggaactaactgttcccccactactttataaacaaatataaaatgtggatgtgtaggtattttaaatgctaacagtagaattttagtatctagttaataaccctattggttggaatttaaatcttttcaggaggaaaaattaatcatccattatatcattcatcttgatgctgtcactttcttcttgaaatcagaaaaacatcgtagtttttacatggtagtttttccttgttggaggacagttgcattttactccacactgttaaatgcattaggccatgtaagagaaatataattctgtaattattcagaactcagttggttgtttatatggtattcagcaagatacttcccccccacctccaacttcttataacacaatttcaaagcaccaatcgtcttcctcttttaaagtaacaccatgactgattgccttaaatttatatatgatcttgttctaatgtcctttctaaaaataagaaaaaaatattccacaagtaaaacgagagtatgatagatacttcaccatggtgctggtgtatgtagacttgcgtgagggggaggacatggaatggtatgttctccattcatctctagttttatttcctagatgagttatgggtgaatactgtgacaaaaacaaaacaacaactaaaatggaaaagtcccaggagtgaacagaaaccaggacttaaactgcttcatcattattttattgtattgttttcgttttgggtttttttttttttttttttttttttttttttttaaggaagttacaacaaggagcagctaaggacagataaattggtagcagattgtggtttatgataacgacagtcccgaaggaacttggctttcttggtgacgttgaagtaaattgcattactcaagatgtatactaagaaggatagataatgaggtgtatgggggaaaggcatgatgactatttttatagtattgttgactaccaaaatgaatggaagggaaggcgggaccaggtggagttccttgggttaatttcgatgtaccttataaatgacaaaatttccacccacttctcttagagggataaaaatatttgaaagtgtctgaaacaattgccgaccactatttcaattccttttcctaacttctagtacctttgatttactctgaattcctaatttcttgttaaatgggaccatatttgtttataattcacctgggttaaaaataatgttttcttctgagaagaggaaagaggaagggagtgctctagcttcttcatccagaaacagactcttatgtaaaacccccaggagattctataagatatcagggaagattcacctaaagattaggaccctttgagcctgacaaatctcctgttgaatgccttgctttcaaccaaagctgagataaaaagtgcgcgcatgtgcacacatgctcaaatacacaggcagaaagctctcagctacaagacctgcttccgtagtttacagagcacctgtagcccatttcccctgtgttttttaggcaaatctttgttatcatggtgtatgacagccacatataatctgagtaccacttcctcccttcttaattttccaccatttatgccaattagaagcaaaataaaagggatgatttctggtcacttaaaatcggggtgaagcaaggatggaggttgtcctgcaaaggcattttaattctaaagaaaaaggagattagtggcctctacccatcttagagaatagagtgtcctgacaccttcccttcctccttgctcagtattctccctctccctagtgccacattgagaggagattcactcctaaaagagtgtgtcattttaagttgactttcttggagctgagctaagagccattgccaaggccagtgggcgtaaattcagtccgcctgacgggagatgaagggttgtgggatttatgacttatttgagttctcatatatcaccctctgtgtcgctcgcttatgatggccctgccaaaagataaagaagtgtaggacgctggtacgggctgtggtgacaggccagggacaaatgtctctgttgggtaaattgatttgaatgactctagtgaaatatcaggttaggctgaaaatatgattgggtttaatgatcctgctgactttgtagactgttgggattccaaatcctggacaagttaattaaggcattctatgaagggggtgtgtatgaatatttgtaaatccatgtaattattaatgtcaataaataccaccatgtaaaaactcagacctgttctttcacataatatattgaatgtccattgaatacagggaacattacttacaatttatagagtatttatctgggaaaaactgttgagaacgttattttttctccacatcccagagtcaacaagcagagaccgaaaggcataaaaatgtggaatgaaaagatagagaagagataagcagtttattctctcctggcaaaatttagtagccttacccttaatagtggagaagaaatttttatgtgaaattggggttgttttaggccactaacccaaagatcaaatggattgctttttcaattacaaaaacacatatattgttaccttattttttgaatgtggctattcagttaaaaataatagagtttagatttctttgtaggaccaaaattttttcagcaggtttctgtttttccacttaaaattgcttccaaatttctgagtttacttctaataatgggtatgctctccttgctatttttatctctaggtaattgttgactgcttgtagttttttcttgttgggcatgaatgactggcttcatcttccaaaagtgttacaaaacaccagttatttctttgagctttagacttttcctttgcagaaaggagccttatttacatccaaatgaattcccaggagagttttccactgatgccgactggttaacagaagtacaggcgagcaggaatccctcgctacctggcctttcgttccctggttccatctggatctctgggaaaattttccatctttatttgccataaagtatgatttatttatttcaacgagtggctaagagccctggaatgccatctttaatgagtgtagggaggatggtaaattgggtttagagaagaatattgttaaatatgttcaacttttagaacccaaacaaaaacacaaccagtgtcagtgtttgagagtgctgtactcatctgtgaacgtaacagagaggaaaggtgtctccgaaagaactcttcattcttaggagaggccccagaataatcacaaaacttggaactgtatctatggaatatagaggtttccttgtcttggagtggattcttagagtaaaacatgcctatatccttctgttcttttatcaacttcaactgactgtgaatgatgtactcactgagaaaaatccatttgctcaggtctaattttaggtaatttctctttctgtatgttaatggaacccataactgttttgcctactggtttccaactgaggattaatataacagtttccactcaacaattgtattgcttttttatcccccttatttccttttctttcttcatatgagaatattgagaataagagagattaggaaatttacactgcttctgagggacaaggcagcttttggacccaattatgcatgcctctgaaacacatgttctgcaccacaccattttttctgttatgtttgagagataaaaagttgtccgtctgtctacctctccaggctaatgtctcaccacattcaatcaaacttctccttccccaggccaggattcatgcagtccctacctgtaatgtgctttttcatattcttttttattttaaatagagacagggtcttgctctgttgcccaggctagagtgcggtggtgcagtcatacttcactttaatctcaaactagactcctgggctcaagcaatcctctcatttcggccttccaagtagctaggactataggtgcatgccaccatatctggctaaatatatattttgtgtgtgtactttttgtagagacaggatcttgctaggttgcccaggctggtctcaaactactgacctcaaatgatcttcctgcctcagcctcccaaagtgctatgattataggcctgagccatcttttcattatctttcttcagatctcaaattatttgtcactcactggaagtgtacagctaatctgaagtggccttccacagttcccatctcgctcattacctggataatttcctttatagcaatgaccacattttggtattgttttggatattggttaccttgttaaatgcctgtctgtcttatctcctccaaccaaaagtaaactctctaagatcaggaatcctgcctaagtttttggcctgcatatcatcagtgtcctgcatatagcaggcccaatagttgttctaaaaattaatgtatacctgaatgaataaaagctcttagagtgacagaaatgtaaacaaatacttctaacgctaagaaaagtttgttacatgttctaacaaagatttaaccaaaatgttgtggctacaaagaaaaagatgggtgaagaagaatggacaaacactaggggaacatgagaaagttcctggaagaatattgtcatatatgaattgagactggtgcatggtacaatttcatatataaagatagtggggaaagcattcttggaaaagtctcttgttgtgaggcattacccagagttctttgtcttaaaaccaagagaattaaggagcatggacagaaagggtgaggttggagtgaaagtttaataagtgaagaaagaaagctttccaccacagagaggggtcccggaagagggttgccatttttacagttgaatgcaaaagaaactgatgagggctgggtgtctcatgtgcataaggtgtgaatttctggtagctccaccttgtcctcctaatgcgcatgtgggctcttagcttgagttactccatattgctttgttccccttactgcacatgtgttgaggtggaatttttcattgcaggcatgtctgggcaagtcacctgtttagcctttcttatctgtgtggctgtgggcatgtcctagttaggcaagtcccattttccaagttcccttatctgtgcctgcaggctgttctttcctttgagagaattcagccaaggacccaccctaactgcctgcctgaccactttcttcctttctcctctctcataatgatgtaacagtaaaaatacctgagttcaaatcctgatttttccttttaatagctgttgactttgggctatgtgcttaaaaaacattttttgcagagctttctcaatacttggcacattattgtcactgtttctccctggatcttagttttttgggttgctaagtgagcataataatccatagttcagaaatttttgtgaaataatgtatgtcaaagagcatggtttttagcaggtactttcattcatagagatagtagctgagtttaggtgacccgttaaatttgggaaaggattatttaaagtcaaggagcagatccattatgacaccataattagaatggataaccacatccgcagaaagtgcgctgcactatgagtaaatgtaattttgttcgtaaagtgctgggcctagggttaggggagataagttcttaatatgtcttaatatagccttgggttctgggatatgctaaaaaattattcaactcattagtgtctcagtatccttgtgcttaaaattattattataaaaatacctgaatgtgaacttaacctcttcttgagagtttcagtaaggaaagtgaggctcacttctttctggaacattaaacttaagcaggaaggtgccacatgaagtattatatcataatggaagcaatgtaaaaagaagagtgagtcacttcatcaacttcacaatgcaaaggtgctaccataagtcataattctaatacaaagatttatataaataatgattctgggattagccagatctcctaatgttctagggtttgtcatcatgaattgtggtatcacttagtaagtacatacttaaagagaagaataggaggggagggaatgttagaagaatagtgaacaactaaaaaaatgtgagagatagcctggagagaaaagcaaaaggacaaggcaacacaggaaaaagcaaagtggagaaacagatatgcctagcaagaggaaaccaaagttagcccggtagggtattgttgcaaaaggaaagccggccttgtcatttatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgttaagcaagcttgagccaggttctggaggaggtcatcttgcaaggataaaaaacattgcatttattggatgaatacttaatgcacggtttgccttatccctaccttagagatgagaaaactgaggctaagactagctaagtaatttacccatgtttgcatggcttgctgatgatggatccggatttgaattccattttgtctgactccataaatcatactcatgctagtacactgccctggcctggatgggccattttacattgtgtttttcttttatagacattaatatgtgtaataaatagaatgggagtatgtattattaaatgttaattttgaaatataagattgttttcagatggaatatccttttcattctttatgatccttaatgctgatttgaaaattagaataggaaaggtatggcaagtgtgtatttgtgatgggagtagctaacactgctcactttaacagtaaagctctgccatctgggttattgcaaattcttgtaaattggtatggcctgtcctgctgtcctggaaagggagcaactagcacaagagaaaccaatcaaaatgcagcaaaaggattttttttttttggtaagattttgcttaattatcactgcagtagaatggctagccaaagtcagaaatcttttatttctgctcagtgagcagcccaataaagcttcagaacatacagcacaaacaaatgccatttcatttttctttacttcttaaaaaaagttaatcaggaatttgttagaataatcctgtgttaaatcaagcagccagacaatgaaataggaattaaagaaaatgaaagtggtgggaattatagaaatattaaattatttcaaaaaccctaccaagtgaattggttaataagcatgtacaatttattgccctatgggtcctctttttacaggcatctttatggttcatcagtttgctcccatctacaccacctgcctataattcttgacaaaagtctgttttagatactgaaagtatccactagatttgagaacaaagcaaccctgtagcgtgagcccagagtccagaaggatgtgggtggaggcggatcaggatccaagattttagcaaaagatggcttgcttaagtgaagcagtttgcactctgcctctttattcagttaggcctggtgtcccttccagcaagaaaagcaactggaggtcctgaaattgcacactcacccaatttccccaaattctttacttctgaggactattgaatcacagagatacagcagtagacttcatgaagttcatctagcacctaggatcttgggatctatggcccgggacagctcctgctgtacaggtcttgggtaggctgccatcctctaggtggtggcggcagtgtggcttgtggttctttttgagtgtacactggctgccttacttgcgagaatctagttctatcaagtgtcagttaaaggccgtttttgtctctgattgcataacagggtatgtttgagagagacatcgctgagagaaattcaaagctaccatgtgaagatcctttcctgaatatagtgtggctacctcagatcaggattctcaagcttggcagttttgacattttggactggattcttttttgatgtggggaaactacctgtgcactgaaggatgctttgcagcatctgaggatgacccactagatattagtagcacctttctcccatggtaacaaacaaaaatgtctccagacatttccacatgtcttctgtagggcaaaatcccactggctaaaagccagtgatggagtttgtactctttgaaataagaccactgactttttgtcttccacctaattacgctcagtaagataaggccttcttttgaggtagactttcaacatctatctctgattctttttgagaaaacacgttgcattttaatcttttagtgaccgattgtccccaaatgtaaaatagaaagttgagggaggcagtagttatatgcacatattttttgagccagagttccctgagtttgagttaaggtgtcctgagttttgagttaaagttccctgagtttgctaccaattagctatgaaacctgggccgagttaaaagttagacctttacagtcttaagtctccctttttcatgtgtaagacaagggagaataatgattgtacctttttcataggttttgatgatggttaaatgagttgaagtagtgaaagctcatagcacaatggctggcccatgttgaatgcctaatgaatgtttgctataattactactgttgatgataatacttttgaaaacatagttgacttgttataattaagccagtgtttacatctgctttaccaaatacttcccatggtttttatctcagaaaatagactcaaaagtgaacacacacacacacacacacacacatatataccacacatatgtacaacctgcatcgtctaataagctcagtggttccatatactatatctttggccaaatccggggctttctgattagcacctctagttttttttttttttttcttcccactcctgctataaccattctcagcattttcttccagttttttccttctagaactactgccaggtgaactacaaattattttcttgatttgcagcccatgcaccaatgagaaaatgcctatggtgtcttttgattttatggttcattgcttaggccttgtcataaaaaccatggcgtctcttaaaagaaaatataaaacaaaaacaactttctcttggccagagtttatcaaacctatgcccataatggcatagaaatataggaaatgagacaatcctactcccccaatccccgttttctgtttatttgtttgattcctgccaaagcaaagtgaccttgagggggcaccggctcagtgtttgctttttctggcgctacccacacccctccttcttcatctcctactgctccccattcagctcctcaacaatcggcaatcactctgcccttctgctccaaatttatgaccgggagcaagccataaacagagaaggccaatcctgatcctaggcactgcaccttcctgtttgccagaggtatgacagcttgatgggactgtaaagaataagcctgcatccccacaagccgcatgaatcatgtcctaggataatgactagcaaaggctgctgcagagactgcaggtgactcagagccctgaggcagggctttccctaaaccacctagaacaaagggttcccatggatgttctctctgtggcgtcatctcacaaatgagaagacctcacccactctctgatctataaaagcagcctttttattctgtgatccatgtgaaatggcaaagatcactccagcttattgatgctcagagaattatgaaggtgccacctgaatgatactcctataggaaatatttggtgaacaagataacgttttttcatggatactatttgcctcctccagttgccgcttggtgtgtatattattcgccagtgattgataatgcctcgggaccacctagtgatcttgttcagtttctaatttagttgatctgaggtggggcctgagaatttgcatattttaaaaactcccaagtgatgctgatgcaaaacagctagaagagaataataattcaaataaatgttcctggtgtaaaggaaagataaatatttcaggtgatggatatcctaattaccctgatgtgattgtatgaatgtatcaaattattccaggtaccctgaaaatatgtatatctaatgggtaccaaaaacaataaataaataataaaaatctgctttcaccaactgatctaggtttaagcaatggagtaacatgacaccagtataacaccttttgcatttctgaaagcttccttcccctcctctttcccctcccctcctctcctttcctttccttctagatctgacagtagtagctgcagcttatgctttagatttgagatacacagttgggatctatgatggtccctgagaaaggacaatgagtagaagaagcaaggtgcagagaggatctaacaatttttgcatggacatgagatttggagcaaggtctagaagctcatatcagcaaggagtaagtatgcttgtggcttaaagattatggtcttcaagacttgctcctggactggaaatattcccctaattttttgcctaaatgaaatgtgctacaggcctgagtatacctaaatcagcttcatttttctgtcaaatccctccctgtatgcttcttccagtgatatgtcatgcagatgtccacaggggacataggatcttgtagtgcaaaaaacatgagactttcatcagacaatcagtcttgactctcagactcactgttgattctatgacctagctcaagctacttaactctctaaggttaaatatcctcctctataaaaacctgatagtatgtactaaagagggtatttttgaaaattacatgagataaaacagcctagaatgctatctgatgcaatagtcatccagtaaattttaatatcattctactttgaaccaggttgtttatattaaatttaacagaattaagcaacatacagtagcgatttattctgtgggctctggagtctgcctgtaagggtttgagctctagctcagcgacttctttactgtgtgaacattgatatgtttactttaatctctctaggccttagttttctggattttgaggcttaaatgagttattacttgtaaaacacttaggagagtctctgctatgtaataagtgttcccaatatatagattttatttcatctagttgaatttagagagtagcaagccactcccttcccgccccacccccgaaaaaaaaaaaaaacacaccaccaccaacaacccacttttagtgtggcaccatatctaagaaggtattctccaagacttctttatgtgaagtagttcagccttggcagagttaaaagttttcagttataatcttgacaaaaattaattgggatgtatcatcaatctagacaatagctaaaattataaagcttctaggagaaaacatgggaaaatatctttgaaagtgtgaaataggcaacaatattttagaatacaaaagcactaagtatataaaagaaagtatcaatagattcaacttaatgaaaacaaaaattcagctcatcaaaatatatacctaagaaaattaaagggtaaattttaaaatttttgttccccagacatagactgggagaaaatattttcaggatatatatctaaaaaaggacctgtattcacaacatatgaggatctcctgcaaatcaaaaataaacacaaacaataaaaataggcactttataaaaaagatacgtgaatggtcaatagtcccatgcaaagatattccacatctttagtaatcaagaaattgtatattaaaatcacagtgatgtatcattttataccaactaaaatagttaaaatttaaaagacggacaacaccaaatattggtgagcattagaactactgaaattgtcatactttgcacatgggaatgtaagatgataaaaccactttggaaaaattgcagtttttaatatagttaaacataaatctaaactaagacttcgtaagtttacttttacatatttatccaaaagaaatggaaacatatatacacaatgacataaaaatgttcacattagctctttaatagtctcaaaatgaaaacaagacaggtatccatcaagagtatggataaacaaaacacagtatattcctatgatggaatactaatattcaataaaaataataaactacaagtaaatgcaacaacatgtatgcatctcaaatacagtatatttttgtggagagaaagacaccaaagagtacatactatataatttcatttatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcaggggtacattgatttgttaaaactcatccagttgtatataggcattccttggagatattacaagtttggctccagaccccataataaagaaaatatctcaataaattgattgacaccgattggcacacagctttatttcccagtgcatataaaagttatgttgacactattctgtagtcttttaagtgtgcaatagcattaagtctaaaaaagcaacatgcacaccttaatttaaaagtactttattgctaaaaaatgcgaatgattatctgaggcttcagtgagtctttttttttttttattttttgctggtggagggagggtcttgcttggatgttcacagctgctgactgatcagggtggtggctgctgaaggttggggtggctatggcaatttcttaaaataggccgggcgcggtggctcacgcctggaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaaaaaaaaaaaaaaaaaaaaaataataataataataataataatatgatggggtgtgctgcattgactgattcttctgtttacaaagaaagatttatctgtactatgtgatgctgtttgatagcattttacccaaagcaaaattttcaaaattggagctaatcctgttaagcccagcagctgcttcatcaactaactttatataatattctaaattatttgttgttatttctagaatgttcacagaatcttcaccaggaataaattccatctcaagaaaccactttctttgcttatcatacgaagcaactcctcattcattcatgttgtatcatgagattacagtaattcagtcacattttctcctgtacttctgttctagttctcttgctatttccaccacatctgcagttacttcctatgccaaagtcttgaaccccataaagccatctacgggggttgacatcaacttcttccaaactcccgtgaatgttgatattctgaccttctcccatgtatcatgaatgctcttaatggcatttaaaatgatgaatccttttcagaaggtttttaatttactttgcccatatccaacagaggaatcactacctatattagctatagccttacaaaatgtatttcttcaataagacttgaaaggtgaaattactcctcgatcccttcaatttgtaaaaaatacaatatatataaagcacgatgaaatgaagtgcaataagatgagatatacctatacctaaaatcatgggctccactctgtataaattgtaccacaatttaaaaatgtatatcatatatatatttaaatattataataaaactaattttgaattattcttgattctaggcagtctctctgcaggagtctcactctgtttgttagactcttttcttccaccagaatttctgtcctgcagctcaccattatctagaaaactgagaaacaggaatatcataacagtaaacaaaagtcacttagttgattacatgcatctctcaaaagcctgtaccttctgctatgattagattattccagaagcctcttctggaggaatctcttacatttgcccttcatctatgggattctgcactttcgcctttctgtttctgtgttgtcctgagatatctcatgtagaaatgaattgatggccctttatactgcggttggactcttcattcagattttttcaaagcacattataaactctaattcattaacgtcatcataaatggtaatgtcctgtgaaaaagagaggtggtggcaccaattaaaataatcttcttgtagtcacacatcaaatcaatgtcagtgcaaacacttgaaccaccagttaatgcagccccatttctttttatattgacaacagcacagtggttgaagctgaaatagaacctcagttcatacttatagaatatgccatgctgcacttaacacatggatctacagggagaaggaaacagaagtgaacatggactagatgagaatctgatggacgatatgtaccacgtgctttgaaatagccataaggatgtctgcacaagaatatccatgcattcgttcttagaatttcagggccggttgtagctcagtcattttgccattgacttaattgaaatccaaatcaatgcagacacttgctcaaggtcacatagcttgttctctcccagctcccctgactgccggcctcaagcccctgcctccacagactgtgggctacagattccccaagagatttccttattccctggattctcctaagtttgcataacagaagtacttaaatgcatcacttcatttgggtatgggattttaaataaataatatgatacaaattctctcacactgcagagagtctaataatagcttacagtaatagaatgaacactctgtgcccagaactcctttgaatattttacataacattaacttaatcttcacaatatcctatgaggggatactattgttatcctcattttattgctgtggatgctgacacatagggaggtttaaaaccctgccccacataatgcagtttgctagtgatagagccagaatcagaatgttgaaggttggttctagcagccacacagtaattgctctgacctatctcctttctacaggaaatggggtagaggagattcgtttcctctgaaaaaaaaatagctaaaacctcaatgatgaaaacctatgagtgactaatgagtatgacagctaatactaaatggacaattgtcactgtgctaagtggtttatttcatttgaattatcacaactcaacaaaaaaaagttattttcatctttctcttatacataaagaaactgaggcaggcggtgttaaaggaacatgcctttagccgcacaggtggaaaagagcatgaacccagacaggctggctccagggactgcggcaatgttgtaataaaatggcatttgttcagtccagttttaattgatgagatactaaacagagtcggcactaaagaaaatttccttggagaaacatttatgcttagctatttcagagctggaaagtccctttggtttgatataaacggccttcatttttatggagctggcatcaaactgattttagaaagaactggcctttctccaagttagccctggtcagaggaacctaacacatttctcagtttaaactagtaattctcaaggaagggcaaggtttggagagagagcagtgcaccgctaagggaggtatcagtacctggaagaggggaagcaaatacatgttctgaaaacaaaacattgctggaagacggatatcgaacttgacctaagattttcttttccatctcccctggctaagatgaacaagtttgcattgggcaagtagagtcagcatttacactggtatcttgtgcttggagtgaaaagcaaaatgaaacaaaaagaggtttctttttctaaaattgttttggttttgatttgcgtttagtcataattcttaatttatgtaatttttaacatttcataagacagcatgaggattttgtttttgaggaacatccattttaagtttgaagaaaatccatttaaatgcagttgggcagagctgccacatgcctatcccatccctgttctgatggtggccctaagacgtttcgaagagcttggattctacttatccaaaactaattctgtacatttacgggatcatcagaatcatgaaaaatgtttctagggattctaggtttttagtagagagagaaaatgatttctaggataaaattcagataagccttgagctaggaaactcatagttcatgttgttacaaagaactaaagctgatttttcagagtaccagcttctcagaggacctgagacttgcggatctcatttacagattccaaaacccctcgcagttacactggactgatttttggcttggaaagagcagtgggatacatcctgcactagcccttgtcctgatggattgagacacaaagcttggcctgagcctctgtgtcaccagtgttagagatgatctttgtttctcctgcagggagctttctcactgccaaatggcgtggggctttcctagctttaagatgaaacaaagagaatgcattctcccatagtcttgtctcatagactcccatctcatgaggaattatctcaagtaagtatcactttctaaacaggttgcaaaaatccattagacaggtaggattcacctcgcctgcccattagggatcagaggctgcctgctgagagcccatatctgcagtgttttctgggtttccttttttgcaatggctctcataccctgatgtcacttgtttggtgtgcatgattgtgcttagccaaaaagaatgtgcagtagtcacttggcctttaagtagcaggtagtgaaagacagcagggagagtgtaacgaatcttattctttcagaaaatactaagattattttatttcatgtttcactctcatcaactatttaattacattcattcattcattgatttaaaactcatcatgttgccactatttgcctgttctatgctagcactggagatctatggatgaagaagacaaacaaggatgctattctcatgtgcattacatttaattgtggataggaaattaaagcaactaaactcactgagaatcagagctaacatttgcccagcacttagtacatggcaggtgcagttttacagcttgatgtatgttaactcatttaattcttctaataagcctataaggcataagctattatctgcttttagagataagaaaatgaaggactagagactttagttaactttcctagggtcacacaggtaggaagtgacagagctgggatttgatccagggctccctggctccaaagctcttgcttttagccatgatactataatgcattgaataatgggcgatatctacctttccttgatggtcaggaagaaaggtcaaaagaaaggttgttagagctaaaatctgaaagaggagaaaagtttttcagataaagagagtgtgcgtgtgtattttgtatgtgagtattgtgcgtgttctatgtgtgctgtatgccgtgtgtgtgtgttgtgtgtgtgtgtattgtgttgggatagagcagcaacacaacagtgtccctagcggaagaagtaatgtctgtgatggtaagggaaaagagggtgaaagtgagaaaagagtgagagagaggctcggacaacttaaacaactggaaggccagcaggataatggttatggtagaggtggagagaaatatgaagttggaatgggatgggatcagggacacatcatgccaagtcttctatgccacattgggaatggaaagtcatgaaaagattttaagctggagagttacctaatttatcatagattttaaaaagattcctcttgcagctgggtcttaagaattagtggctcttcattgatgagttcatgtcctttgtagtgacatggatgaagctggaaaccatcattctcagcaaactatcgcaaggacaaaaaaccaaacaccgcatgttctcactcataggtaggaattgaacaatgaaaacacatggacacaggaaggggaacatcacacaccggggcctgttgtggggtggggggaggggagagggatagcattaggagatatatctaatgttaaatgatgagttaatgggtgcagcacaccaacatgccacatgtatacatatgtaagaaacctgcacgttatgcacatgtaccctaaaacttaaagtatataaaagaaaaaaagaattagtggctcttgcagttgttcaggcaagagatgaaggaggcttgcccttggatgaatggcaagattctgtgtgtggtatgaaagtctagagcttccttgatgaccatctcctaccccatgcatttacagctttctctccttagaaaaggatttttgacataagcaaaaacttttcacaaaaatttgtgtgaaatcttatttggggatttgctctctgtgcaaggagtcctactccagcaggtttcccagtcaaaatatgcctttgggaatgcagagaactgaaggccctggctgagcaaaccccagctggagagacagactggggattctatctgtgtatagcatgaagaatttattctaaacacttggatatagagccaatgccacttacaagctttcctttaagaatcctaggccagttgttaacagtttttaatctccttaatttctttatccatagatacctgacaggaacagtttggactgtggaaagacaataatggtccctttctgaaacagtctcctacttgctgaaggctactggaatagaagagaaaatatagtattttctgaaaatgtaaacagatgttagtttaccatttgtgagctgcagggttcagttaaagtggatgttgtatgtaaatacagtggtagcttgggagctgcagatgtctctaataagcattcccaagtgcactgtgttccattagtatgtgggattccactaccctaatcccactactgtggcttactctgggctccttctgtttctattcctgcaggacacataaagacaccttaggcgttagctgtctctatgtttccattccaccaaatcggaacttcatgactttttcaccttctctctcagtcataagaagacggctttttaaaggatgccaagacaggtggatcatggtaatagtatactccattatagcagttgttattcattgaacacctactgtttgtcaggattgggcaagtggcagtatacatcatcttatttagtctgcacagcaggtttaaagggagataatattactccgactgtacaggtgaataaatggaagttaaaataatctcggcttggtagtgatggaatcaaatgatgtaattgcctcattgtgaccagctaagggcaattctgttaggatctgtgtaacacattttaagagaaacattggcaaatgaagaaaggttagaggaaaacatctaaggtcatttaagtatacctatatacatttctctcatatgatatgacaggcttgaaaaattacacagctcattacgagcaagagagcagtatatatatattaacattctaatcttaataggaaaaactaaaggatgctgtgggaataaatggaaggatcatcatacctagccaagaaaatgataacttaggtcctggataaataaattttaagtagggaaaggtgggctggagttaggagcattctaaactcaatgaacaacatgcacatgcacttggagacagtgcaggtcaatttaggagctcacaggccatttagagtgacagaagcagagtgtgcaggtcaggcagtaataagacatgaggctggagaaatgagtaggaagcagatcaaaggccttgaaatgtcaagaactttgtaccttatgggtactgaagaagtgaaatgtttaaagaagccgaattatatgatttcttttgacttcaaaatggaaaatacatgtcgatattgggggagaaattaggaggttcttgccataatacaggtggcaaatgatggtagtcttcaggtaatggcagtaggaatgcatagaagaacacagatatgaaagattcttagtctggcagacacctggaagcaagggtgcataggaatagctaacagttaaaaaagtatttggagagctatcatgtgaaacagagagatgatttattttttctgttcatttactgagggcatagtaaggactaattggagaaagtcatagggaaacatattttaatttcaataaaatctgatgctccaaaaattgaaaacataacttaccattcatctctgaatgtatccgtgcattttttttttcattcaagttacatttttaaatgatgtgcaagttctatagactgggtaacagtgtacataacacttaacaactaactaaaatcagtgaaacacatatcaatataaacaaagagctatggaaattaatcctgtccggggttcagaggagttattaattaagatggtaaaactagctgaagggataattagagggaagagttgtgtggggtctgcaggatctacaagtggaattgcccacagaacctttagatcttatgaatctagagcttagaaaatagtcagggctggtgaagtatactggggaattttcagtgtaagcaaagaccatcaaagcaaatgtctctgaagaataagcaagtaatacaaataagtgagatggacaaggcataaggcaataagtactgggactatggaaaattggcaagcaggtgccccttccaaatggcaccactgccagtcagctccagtaaattgttgctctgtgctctcagatctccacagtttctaaataaaaacaaaacattggatatttatgtgatgcttctagttaatatgatatctcacagcatgtccttgatctaactatagcccaaaggctgtcagattgccttgtatgttataagatgattgttgaagctgtgagtaagactgaaattttctcaagcgagtagaccactggaatgtatacatgggtaatctttctcaagtgggtaaccaaatgttatttggtatgtaaacttttctatttccacatctgaggattcatgctgctataagtgatgtctgagaaagtcatgcagcacattagccagcaaggcataaaaggcaaagagagagataagaaagatgatgttaatctagagcctaatgaaaatgtgggagttcataaggagtgatcaaatacgtaaggtgataattgtggatatgtttcgatatcagaaaacattgcttttctgtgtgatagtgctttctttataattaatgtggatttagtgtgtgttatttttagccttttaatccctataaatgtgccacttcatattctacgactgaaaatggcactataaacaaaatggtttaggaaccagtgtagagagcaggagccaaagatggaatccagagtcacagcatgagggatgagtaaggaagatgactaaactggtagattttagaatgagctatagcagtatcaccaaaaccaagagtggagagaacttcaagaggaaagacacatttggaccttttaggtaactgaaaaatggcaagtccattgggtttaaaaggtaaaggcttctggtgacctctgagagggcactctaaggggagagttggcaagaatccagtttgcactgcactgggcagtgaacgggaggtcagtgagtggagtgattgccaactgctccttgggcaagtttggcaggaaagggaaggagagatgtggtgccattccaaggatgagacgaggttaaaaaaaaggctttactcattttttttctagtggagtagaatttataatatattaagactaggagtgataattgatgaagcaaggtacggaatgaggcataaaatggagagatcagagttagagcaattgataattatttttctttcagacaggttaaaaatatgaatctttggatgtaaccgagaggaaaattgagggagcttatgcctgatgcctctacattttctctaaagtaggagatgcgggaaggggtcagtagagagttgtgggctggaaaaaaaaagtttggaggagctgctgtagggaatttaacaggggtgattaaaaggattgctgaggttcaaactgaggttggaaaccattaagcagcaatgatcagtacagttgtgagcatttctccaacagtatcaggaagtccaggaacaggaaggggaaaaaagagggtctgtgttgctccaggtttttagaataacaaaccaaattcagcagaagatcaaagtgaaacagacaagcagtatgtaagtggagaaatagacaatggaacacaggcttgagaaggacataaaaggagtcaggagaagactgattttctgagagcaaagagaatccctgagatatatatatatatttttaatattagaatgagagattcttgcactgggtaggactttgacctgagtgaactttgaggttcctcctaattccaagattctttgattctagacatgagaaaacaaagctagtccctatgctgttgtcataactgtcatggtatgtgatatggtttaactctgtgtccccacccaaatctcatctcaaattgaaattcctacatgtcaagggagggacctgtagtccgcaagtgttgagggagggaggtgatcggatcatgagggcggttctctccatgctgttctcatgatagtgagttctcaggagatctgatggttttatgaacgtgtggcatttcccctgcttacacttctctctcctgctaccatgtgagaaggtccaagattgctttccattcaccttacgccgtgattgtaactttcctgaggcttccccagccatgtggatctgtgagtcaattaaacctttttcttttataaattacccagtttcaggtagtatcttcatagcagtgtgaaaatgaactaatacagtatgtaaaaatggaagtcctgtatatacctgtctctctcaggattggcctcaaggaaccttaccaagtagatgacatttctcacttgttcctctcacttgttcctctcacttcctgttgtagtatcatcttctatttattctccttatcaccagcagatcaaaacaatgagggcattgatctatcataagaaggctgccttcaggccctattctttttttttttttttttttttttttgagatggagtctcactctgtcgcccaggctggagtacagtggcaccatctcggctcactgcaagctccgcctcccgggttcatgccattctcctgcctcagcctcccaagtagctgagactacaggcgcccgccaccacacccagctaattttttgtatttttagtagagacggggtttcaccgtgttagccaggatggtctcgatctcctgacctcgtgatcccccagccttgacctcccaaagtgctgggattacaggcatgagccaccgcgcctggcctcaggccctattctaataaaacttccaggtagatgcttgttctccttctctgtgagtccaaacaaggtctctagttattgattctcatgttattgcagcttctacaaatttcaccctcaagtcagctttttggcttttctgactcaagtcacaagataaccatccttttgtttcatttttgtaaattctcataaccccaactggatggtagatgaatatgaggaagaggggaaatcaaaagaatgagagcaatgagcctattactcttgagatgaacagagggagagattcaacaccaaatgcgtccctcttctgaatcccatctctcgaatcagacagcacttctgtgtacttcccaatatccatacaaataccaggaaacttattttacttgcctctggccttggtttgcaggtttggggaaacacaggagtcaaacagaatttttttgggtgaacccacagatttcactctgaggaacagctcccttgctgttgagacagctgggtgcactaagcaacacatttgaaatatgcctcagactttgtggaaccaggtagtctgaaatcttgccaggactttagtgcctcttgggatacttctgaggtagggcaaagtcccattcaatgttctgttggaggagagaatctttagtgaaatctcaagaatgaaagccaagaagccttaagataagagcgagagattcaacagcaagtactatctgtaagaactttgatttcattgcatttaagcttcttttcctagtggactgtttttagttgaatacttcttgaggataagtgttgtgtcttctatacttatatctgcagcttagcacagttcctgccctatggtacatgttccttatatgtacatggaaattagccaaatgtcaggatgccactttttcatctccatctctattcctatgatggatgactggtaaatacttctctgactatgtatgtgtagttcaaatactctagtttttttttagcataaagtgctgtgaaatcccaccatcaaaagagccaaagtaatatgatgaaaagaatttggtttcagaattaaaaagaaagcacacatttttgagttctcgctcaaaaacaattttgtgagggtaagttatttaacttctccgtgtctcagcttcctataaaactagaattatgagatctctcttataggtttgaaataggatgaaaattcctccctctttttttttcttataacctctctcaaaaccttgcctgtgtctctatgagtgtgttgtgttacagttactgctataatttctctactagattagggtggagaagttcccatggctgttcgctctctcagaggaccctgggcaaagttggtgctcactgtgcatcactgattatatcaaatactgtgtggcatgctcaggccttgttggtctctctgtaccagtgtctatcgtgggacataataattcatgatgaacagtcaggcatctacttagtggcttatacgtagaagtggctctcctttcagaagccagaaattaataaatggtctacagtcagaaggagatccttaattgattaattaattcaataagaatttattaagtaccttctatgtgctaaacactggggagacaacagtgcataaagagatcccatctttgttcatatgaaactatattctagaggaagagacacacactaattgaatactctcacaagcaaaagtacttttgtaatggtaattcatgctacaaagctgtagaccttggtgctatctgatacagagatctgatggaatcagaaagttcaggaagagatcgtctgagagttcctggctagagataggaaggaggggcagagttaaccaggaaggggaggcaaaagtatcacagtcacagagaacagtgtgcaaagcacccatggcaagggggaatgtgataagggtgtgtagtgaatgaagccatagtgactggaatataggggacaagattgaaagtaaaacttacaaggacgaccattgcttgggagtttgggttttattagcactgcagtggaatgctgtgaaacaatgaactggcattgtagaagctggcatagcctgcttttttgaggacatccaacacccatgacaaggtctacggcatcaaggattaccttggtttgtctttgctaaccaaactgggttatacacaagttacgagttgtccttgtcccaactcacaccctcaccattggagaagaatgtggagtgcccctccccatcccggcccatcccttatgtcggtggactaacgcagcatgcctaatgccagagtgggcagaaagaataatagctgttgtttcagtttacctgtactaatttatcacaccttacccagagactccagctccactttctgagttttctctgtctggaggtgaaacacacaagcacataaataagtaggaagctgttaggaaatcctctttgtcactactgaagcatgttcatttatttagtaaaacgtccataatttttaaattgctttatttagccactggctatttggtatcttcaaggggtccccattaggagctgtacttccccattacctgcaaaaacaaggcaggcttttgatccctggaattaattacatgcaaagattttcattgcttggagcagcaagcagctggttcctacgggacccaggctgaactctcttgccaatttccctctcatgcttgtccctccctccacacctacaccctttctttctttcattatgctcaatgggttcaatctaatgagggaaattgtaattaaacatttacaaggttccagttttctctatgactgcccttaagactgtgaacattcacagttcactctttttccaaatacagcacaatggcaaagtttccaggaatgtccttactgactcaggccccccagaatggtattaatccatttgaaaacaacttcacttgagttattagagctggggcaaaagcagggagggagagatctactcgttagggatgagggagcaagagcaatgatgactagcttttgtcaggacacaaagtgcgtctctggtgcttgtgcagatcagttgacaatggtttatagcttttctaccttcctccctttcctattaattattcatacttctcctaccaagagaggggtcttgttttccttttaggtgtaattagagtaatcaaagggtttgtaacactcatgtgttttatttctcattctctattcaattttgtttttcatgcaagagaaaaatataaaacacgaaacaaaaaccccaagtctctgggtgttgtgaattcttgcagggaaaattggttttaccatattagcaattggcagcaataattctgaggtgaaaaacctgaaattactcccttaaaggcagtaatttgtatagtatgtattttgagaaagggggggaggagtaggtgataatttaggtgaatgttagcagtttatctttatattttgtgataaacgaggaagccaagtgttggtgtgttcaactgtggacatacatttgcatatggttttgtttctattgaatagattttggtttgaatgacaaattaaactcccagcttccaaacactgaattcttttgttcagactttacacattcttgaaaggaaaggtgcccacatgcacttatcctttaagggtgaggttaggcaagcaaggaattgacagttattttatgtttttttgttttttgtttttgtttttgagatggagtctcgctcttattgcccaggctggagtccaatggcatgatcttggctcactgcaacctctgcctcccgggttcaagctcttcttttgtctcagcttcctgagtagctgggattacaggtgcataccaccatgcccggctaatttttgtatttttagtagagatgaggtttcatcatgttggtcaggctggtctcgaactcctgacctcaggtgatgtacctgccttggcctcccaaagtgctgtattttaccttttatattaacaaaaccttcttcttgcagttcagaacccataggaaatattattggaaaggtatttcaccacatcatcacaggcatttctatggtgacgaagcgatgtgccatgaacaaagttatgccattttttaatacaagccgaggaaagagaaaaaaaccaggagcaagccactgcttcagggattggcaacctctttatgtttgctcaagatagagcgaaaaactcctaaggttttaccattaaagaaccaaataaaattgtttaacatgttggaattgtgggtcctttttgtatattgacttgagaaaaaataaaaatattgatacagaaaaaagagaatgcatatgatctttttatcttagccaatatattatgttttcttgtttttgtatatctacatattcataaaaacaagtatgtgtgaagaagtttacatcacagtgcaagtgtgatccttcatataaaactaaagcaagtgaggatgaattcctaaataattaaacggtaaattacttgtgtttgtatcagctcttgagccatcttaaactactaatcaatttctcataatcatcagtgcttttcatctgtgagcggattatttggtcaaacatggagacaatggcacagccgtgagtagagcccaggtgtttttctccgatttctccacagaactacaatgccagcagaaaggtagagtggagtaataataaaaaccaggtttaagagaacactaagtttttttttcagtgttgttcacggaactgcaagtggtatagaggttcaggaagtcattacagtcttcataggggtgcaatagttctcacttctcctttcaagaagagttgtaatggaaagttgaggaagaacagtagggacacagggacaggtggtgtctccaattggtcatattctccaagttatttttggtctatagttggttccctaaatctcacttcttctcttcctctagctttagggactggactcagcattttggtttcatttcttttttgaaaagtaaaaagaaaatttacaaaactataaaacaagttatatatgtatatataaaactagcatattaacaaatatatatgggtaattatataaaattatttatacatatataattacccatatatatttttcataattacccatatatatgtatatgtatatatatatataattacccatatatatgtatgtgtgtatatatatataattacccatatatatgtgtgtgtgtgtgtgtgtgtatatataattacccagaattaaacacctttaggtgtaattagagtacattaaaatttggcatactttcctttagttcttttctaaattataaaagtaacatatagtatatttttcttctctaaaaatattgaaaagttaaagtttccttatccactttctcctcaaccagagctgcttctcccaaaatcccaagggaatcattattttgagtttgctgtagatacttcaaacgtttaaaatatgtatttacatgcatatatatatatacatctagaaaaatactagcatatgttattttatgtagtttattcagttacttacatagtacagtgtactatgtaagtataattcacatcttgcttttttctttcaacactgcatttttgatgtataggtccctgatacactgggtattcttcagacggataacatttgatttagattctgaaagagggataagattttgccaggtcaagaaaggaaccggtcaggtagaacattagtttacgtattagcacttacttcataaaggcatggaatagactgcggaaaatcaaggttgctggactttagggtggaactggtgagagaagagacaggagactgagtaaatgcagaaagggtggccatgtagcctatggcagatattttgaattttcactgagaggcagggatattataagtgaaggtgaagtgtatcactttgctagagctgctgtgacaaagtgccacaaaccaggtggcttaaacagaaaatgtgttgttctggagactagaagtatgagataaaggtgctggcggggttggtttattctgagaaccataaagaagaacctgccttgttctctctcctcttcttatggtttgccagtaatctctgccattctttatagacaagtcaccccaatctcggccttgatgttttcgtgacattctctctgtgtgcatgcctctgtccaaatttaccttcctttatttttacaatttttattttaagttcaggggtacaggtgcagtatgttcagatttgttacctaggtaaacgtgtgccatggtggtttactgcacaaaccatcccatcatccagatattaagcctggcatccattagctcttctttctgatgctctccctctgcctccccttttgctgtgcagaagctctttagcttaattagatcccatttgtcaatttctgctttggttgcaattgcttttggcgtttttgtcatgaaatttttgcccacgcctaattcctgaatggtattgcctagattttcttctagagtttttatagtttgggattttacattttttaacccatcttgagttaatttttgtatgtggtgtaaagaagaggcccagtttcagttttctgcatatggctagctagttctcccagcacaatttattaattagggaatcctttccccattgcttgtttttgtcagatttgtcaaagatcacatggttgtaggtgtgcggtcttatgtctgagttctctgtgcttttccattgatctatttgtctgttcttataccagtaccatgctgttttggttactgtagccttgtagaatagtttaaagtcaggtagtgtgatgtctccagctttgttctttttgcttaggattgacttggctattcaggctcttttttggttccatataaatttaaattttttttctaattctgtgaagaatgtcaatggtagtttaatgggaatagcattgaatctataaattactttgggcagtatggccattttcatgatattgattctccctagtcgtttatttttatcctctctgatttctcagagcagtggtttgtaattctccttaaagagttccttcacttcccttgttagttgtattcctaggtattgtattctttctgtagtaattgtgaatgggagttcattcatgatttggctctctgcttgccttttattggtgtataggaatgctagcaatttttgcacattgattttatattctgagactttactgaaattgcttatcagcttacgaagcctttgagctgagccgatggggttttctgggtgtaggatcaatgtcatctgcaaacaaagataatttgactccctctctttttattcaaataccttttattttttcctcttgcctggttgccctgactagaacttccaatactatgttgaataagagtggtgaggaaaggcatcgttgtcttgtgccagttttcagggggaatgtttccagcttttgccctgcagtatgatattgactgtgggtttgtcatatatgactcttactattttgagatatgtttctttaatagctagtttattgagaattttaaacatgaagggatgttgaattttttgaagtacttttctgcatctattgagataatcatgtgatttttgtctttagttctgttaatatgatgtatcacatttattgatttgcatatgttgaaccaaacttgcatcccagtgatgaagccaacttgatcgtggtggataagctttttgatgtgctgccgaattcagtttgtcagtattttattgaggatttttgcatcaatatttatcaagtatattggcctgaatttttctttttttgttgtgtctctgccaggttttggtatctggatgatgctggcctcatagaatgagttagggaggagtccctcctcttcaattttttgaatagtttcagtagaaatgtgtactagctcttctttctacctctggtagaattcagctgtgaatctatctggtcctgggcttttttagttggtaggctattctctactgcctcaatttcagaacgtggtctattcagggattcagtatttttcctggttcaaatttacctttcttataaggaaggcaatcatgttggatttgagtccagtctaatgacctcattttaactttgttaccttggtaaagactctaccttcaaataagttcacaatgtctaactgtgagttaggaatttaacacatgaacccattcaacacatgaacctttgggggcaggacttaatttgacccttaacatgaagtgataaaaatattttttagacttgataattgtagctcttgtttgatggctgaagtatcaagaggattatgagaacagacatgaggctatgaatatgttgaaggattggaattttggatcactcaaatgtgatccaaaacctctggacacccttaccctttctagatatattttttccccttaaagaactcaaaggagaacagagacctggaaaaatatctgtggatatctggaagtaagcactgtactagaggttatcttgtatttgtctctagtttttatgttcgattctcagaggcaggtatttcattgtacaaggtgcaataattatggagtatacattttatttaatcacataggaagtggtttattataaaagagaaagaatactttaactttaaacctgttggacaaaagggttaagtataactttctcaattacttaggcaaatatattcttgaaaataaaaagttagaaaagagggaaagactgagaccctcaatgttaaataacattttataatgatcacatgctgagtcaaaggcaaaagcaatttctaagtcgcctacttaattctctagaccatgcctgctatcttatatttatatcttaataaatgtacatatgctgccttgctgttttggggacaatgggaagtataaatttgatctttcttgaattctccacatttaaagtctccacttgtcacttgaattaacatagtattttagcatttaatttcctggggataccagatgttttattttgtgagtttcttttatttatgttatagttgtggtttaaacaactatatgttcatttaaaatgaaactcaaaaaagaggaaagaatggcacaactcaataaatatgtagtttaataatattcagtgaatacgtatgcacagtgaatggaagtctaaataacgtactccagtgaagaattattagatgttgcccgtctcagctggattttcagttatactattcaagctggtgggaggtttcaggggaagaacaggggagaagacaaagcagaaacagccttaggcagtataaattctgaatacctttaatttgattaacttgttaatactagcaggagagttactttgttgtattctagggattataacatggcatcatttgaaatgatatggttcccactgataaggggaggatgaatagaagcatacactgaatttctctccagggcattgagttcctttggcgacagcactgttggctaaatatgaaaggctgtgagatgaaatggcagcaagagaacagcagaggaaaatgtaaggcaaggatgggaaacacatgagaagtttatacctgaccatctcttttctatcattggcttcctatctcctattcttcttctttgtcaatctctgtagcctccacctttgctcaaattggctcagtgatatgattttaatactaagcccacacccagttggtatgaagacattaagtaattaattaattcaataactatttgctgatctgaacaaagtggacaaaaaaccctgtctctgtggaattttcttccaggcatgaggggcttgggaatgggtaacaagtaagtaaattatgtaacttgtttgacagtgctaagtgctacaaagagaaactaggtagataaaagaaatagggacttgggaggttgaaattttataaaaaaaaaaaaaggtcagagaaaataccacttttctgatgagttaaaaagctatgacctgctaatttttatgtatttattctgtgtccattaaaacttccagaaactttctcttgaagtgacatttgagtctcaagatctggccctggtgattatattgtgacacactgtgatcattacaaaaatttttatcatcatgtataactgtgatgctattttgcttgcagcccagacaatgtgatggatttattaaaacattctgataatcataagacagtgattctaggacatgtattatcaggacctcttctgtacctgtgtttggagttgccatagatgaaagtcatatgataagagaaaagcaatatgataatttgtaagtgagctgcttataataagcaggatatgacagtcaacatttttcctttttacctttccttccatctctacctgttttctttgttatagactttgagttttgtatgtgtcaggtttcattcatttgggaaaccaatgtcacatcaaattaggaaggatgttatgaccctctaattggcctttgcattgtacacaagcctcctatgtttgttcgggatagcaccacgcatccttttaaattggtagtttgactgtcagtttccgtaatgcccttgacagtaaaacaaacacaactctatgtgattctattatgaaacattaatcttctgactgtatggtaaaaggaaggggtgagagtttctctccattcccccaaaggaaggaagagtaagaaagaaattaaaaatgtaaaagcactcccaataacaggtcatcaagtcacagcttttcattgtggccactctttgtcagctgtgtgtgtgacaagaaacaaatcacagctccatgatatttgatagccttgagtaattaaagagtcttcaatgctttttggaaaatgttgtccaatattccagccacatgcagtgctcccttaataactcaataactccacatttctctccctgtgtgtgtttgactattgctatcccttttagagatatttgcatgtaatcaagatagagttcaaagatttaccattttccttactattattctatatttgaatatccctcccacttccatttttttcttccgataggggaaataagttaaccaaaattcaaacaaaaatcagttttaaataaatattcctaataagaattattataactactaccacacatacatttatggtaggaaaatttagaatctgtcctggaaaaaaatacgtccagattatttacaaagatttgctttcagaatccctcttgagataaatagacatgttgggggtgattctgggatggagcaaacatgtagtttgggtcgcagtttaacgatgtagccgtagtgtattaaggctatgcatagcaatttctcttgccctggagtagttagtgtcaaactctttttacccattaaacatttgaagtagatttattagctctaaggattcttggttcttcctgaaaaggaattaagaatctttggacagtggacttcttgaaaatcctatcaaatacccctaagtatgtttctggtagcctctcggttgtgctattcagtgatgaataacacagagcttgattgttctaatttagcggaagaaacacattttttttaatgtggtttttgccattttctattatactttaagttctgtgatacatgtgcagaacatgcaggtttgttacataggtatacatgtgccatggtggtttgctgcactcatgaacctgtcatctacattaggtatttctcctaatgctatccctctgctagccccccactacccaacaggccccagcgtgtgaggttcccctccctgtgtccatgtgttctcattgagaaacacattttttaaatacataaataaatatcacccttttgtcatgtatcttcataagcaattgacccaaccaatggatttgcagtcagtgaaaacaactttggatagatgggtggatggatgaatgaatggatctcatttatttgtgggagctaaaaatttaaacaattgaactcatggagagagagagagtagaaggatggttaccagaggctgggaaggttaaggaacttggagggaaaagtggggacggttcattggtaccaaaaaatagttagaaagaataaataagatttaggatttgatagcctatcagggtgactataatcaataatatcttcattgcacatgtcaaaataactaaaaaagcataattggattgcttgtaataggataaatgcttgaggtgatggctaccccatttaccctgatgtgattattacacatttatgcccatatcaaaatataacttatgccccataaatatgtacacctactatgtacctacaaaaattttaaagaatgtgaatggttgaatagataggcagatagataataaagtaattactatttatttttgatttcagaagattttaacagggcccttgattatcattcatctgagatctacccttgtctgtatggcttatttgggttgtaggtaagagtcattcttgaatgagtgggggtttctgattatttttaaacagccattcaagaccaatgcagatacctaggaggaaaatgtttctgatttttatgaatgtgtatgaaaccggtaaatattcataacatagctaccaatatatgcttctgcaagccaatctaaacaaattgccagtatcaaagattctgttgatgaggaatagacagcctgtgtttgcagtcttgttaaggtggttaacagtggtgtcctgattttttccaaaaccttccagatttgggctgctgagtagatgatgctgacttccgatactgcttgttgttgttgtttaaaccattgagcaggttacgaacctctgaacttaaacgaaagaaatcagtggtttcagctggaataaaaaagtaatactatggtatagcataacggagataatacaatttttgtggttttaaaacagagaaaaaagtccctcttttaatgcaaaatcacctgtaaccttgaatgtatcaaccagtgtgacttagctgataatttaggcctatttcatagagctgttatgagaactaagtaaaatcatgcacatacaaatgattagttacttttaaaaactgtaaaatgcttgctgttattgttgctggattgaagagttcattgtgatggtgccattcaatgactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaagtgattttcctgcctcagcttcctgagtagctggaattacaggtgcccaccaccacgcctggctaatttttgtatttttagtacagacagtgtttcaccatcttgaccaggctggtcttgaacttctgacctcaggtgatccactcgcctccgcctcccaaagtgcttggattacaggcatgagccaccgcgcccggcccgtctctaagttattttctaagctaaaagtcatgctactgcaaccaacggatatccccccttttttggagatacttggtaatgtagaaactatttcagagagtcaaaattctacagatagagtttagaatgcacaaaatctagacatggcattgaggcatctagatattgcctttacctatttcctgtaggaacttgctccagattagtatcttaaagacaaattggcatttatttttcttacacacattgcattgtgccatgtaagaaaattacagattaaatcagcattttcctcctgcttgatgtgaataaaatcaatgctgaaatgggagtcctagttaatctatgtgatagaagttactaggaccagtgtttggtggcttaggtccttaaagaaattggaaagctctttgcaatacagtgtgttaacaacagccttttctttttattcccttccctttgcaactgttcccagcccttctttaaaaatctaagtcagaaatatattgaagggctttatttctatccatttttttctatctgcacatggctgttgatattccttcactgtcttggagctatcaactatcagtcttttgtaaagtagcatacatagtaaagtatcaagaaaacattttctcaagccagactgcctgtgctcaaattgcagctctgctacttactggctgagtgaccttggacacgttatttaacctctctgtgcctagtaaccactacataggagggtattttataaggattaaatctctgtaacacacgtagaaaagtacctgccatatggtaggcacaatatacatttttgttaaataaaatgaagcttagtagtttacctgcattgttcacattatctaacacattaccttccacatcgtaggtacacaatgaatattattagtcatgacttatacatgactaaatgtattcttaaattggagtggtacaaaaaacatatgggtccattccacatttctacaaactagctctgcagtcttgcacatcaaattttagtgtctttggagcttccttctcatctttaaaataaaaatatttgcccaatgtatttcaaagggtaattttaatgatcaaaatgataatgtacttccaatgagttgaaaaaattatttctctatatgaaaggtattataacatttttatttctcaaattactaaatcagttctaggggaaatatgctagtaaaatagttaaggcttgacagatataactggtccagaggtcggtagtcatcatgagtactaagacctagatactaggggtctgtgtttgttcttgagaatacagcaaagtgtttcaaggaaggaggcttctcctttacttaccaggcctgttcagctgtatttggctacttcttgttatggaaggaaacctgagcagaccttgggaatccagtgttcctttatcacattcctcagatctgttaggctggacgccaaggacagtagtttgaaggtgtttgtcttgatgctgatggatgttgcagtctgtaatccacgaactgaaacagggcttctcttcattgcagctggcatatcttgttgtgtttatgagtctgacaggcaaacatatctgaagcatatctcatatgctgatctgtgagggagataagccccttgttttgcttgactggaaacaaaataagcaggtggcagaaaaccctgcattgatttctgcttgggctaaaacacccagaataagatcaagtcccccttgggcacactccagcctctgctatttgatcattgatcatttgacttaagtttgcaaattgttgtagggaagtgtaagtttctttctgctttaacaaagctacttttacttattttaattttataagctattagcactattttgtgatagaaaaaactaaaaatcaaatggtgtcagagcttaaaaatctcttacttcatttgccgtgtaatctttatgcatttgatttttgcttcaggatccttacctataaagcatacccatttcatttgaccactagatttttacagaataaaaatagttcctttctgaagaggaactatgaaagtgtatacatgggttaggagatggagctgaggactccaaagtaatcagtccctgataagaacttgagttttgatgcacacattattgcattttagagattttggtctcccagttagattgtaaacttattgaaggcagtaggacattgacaatgcataaatattagttaggaaaatgaaaaataaagtgttgcttaccaattcagagattcagaagaatgtggataggattttttccctctcacctgaaatttcgactttataaactctttttattactgtccttccttttctgatcccttgatgattattaattggttccagtggtgtatatttcagatatttaattaagtcttcctttctgtccaactctctgccaaaacatatttttcatttttatacctgcaatgctcaaacataagttgatgccaaatgcatgctgtttgattacattccatccagatttacttccaagcaggacgaggcctgtagcatttatttcaagtagctttacaaagagccattcttggccctcaatgtgtgtggcaggcggggaggcaggagaggaaaatgaggtagatgtccttcccataccttaactagtttttgagagaaatggaaaatggcagatcagatgccattggccgtttgcccaattaagccatagcagtgttagctaagatgtgatcaatatggaagacttggtctgcagagccttttttagctgtgctcctgtactagtcaagcacctcctgcaactttgtggtaaattcaagcacctcgtgcaactttgtggtaaaaaccatcctcatgagttagagccttgtcttataagaaggaagaggacagcttctgggtgagacacgtgctggccatcatgctgttgcctaatctgtcacctcaactattgattcccagctcttgattctcattgttcattcatggagttgtttctaaataatggtgactagagaggaggaaatggtgttatattagttctctattgctgcataacaaataactccaaaacgtagcagctcaaaaatcaacaaggcattacctcctaatttttgcaggtcaggaatccagatgtggcttagctgggtgcctctggcttagagtccctccataaggctgcaaccgaggtgacagccagggcttcagtcacctcaacttgggagagatctgcttccaagcccttacctatggctggtggcaggccttagtcattgtggactgttggccacagataatacttcattggcacaagagcctttctacaggacagcttacaacttaatagctgtctttgattgagggttggggagaaggtggaagccattgttgttttcaatctaatcttgaaagtgacatcctgtcacctctactgtattctattcatcacttagaagtgagtcaataagtataggacatttaaggggagggaataatcaagggtatgaataccaggaggctgagacagttgggagccaccttatagactgccttacacaggtgtaaaaagcatgaaatagacattagacaaatgcagggtctgctgagatggcgtgtaaaaagttctatcacagggcttgccacagagtagagaagcattgcatttatttcttgccacccccagcacattgcctggtgcattgtgggcactcaagtacctacatgcccatgaaactgtgtctagtttactaaaaacaaagagtctctctgttccaaaagagattaatgtttggtgttatcctttctggacaattttcttcctatgcttcatttctccagttatcgtcaagggaatggatttaagtctgaaataaaatcactcaaaaataaggaatagctgaagcagacctagaattaccttggtggaattaccttcttaagaacaattagaagtttattctttaggtcaggaatgctgttgccaatcttccacagcaggtgataagaattaaattccctcatgaccgaggaaacgttctttctgctaatctggttccacctggaggttcaacaaatagaagatagagcacacggtgtgtttagtcttaaccacatagcccgaggcactggggaagtgtccacacgatgtttgccttctgtgaacctggaaagcaatttttttctagttttcctttttttcctcttcttttcctattcatctgaattcttctgtagttaaattattaatttctctccctacagaatataataaattactatccttgttaattcttttatcaaagatatgtactaggcttctgcttccacatgggccatttgaaaaacagtgcttcatatgatccctgaactttttggcaattataaagagagatcacaaatgagtaaggttgaaaattaaactataactggaatgaaatgtcctataggactaaacctatcagttgtattgcagatcagccccttataattggtgatgtggtatgagacattttatataactataatatataggccataaattattattatatcagtctgtggtataatattgcaccttagggtagaatttgctccatttacattatattcaggcagaaaaaatgaaaacatctgtcagggagagtatagccctattgatcaggtatatataagtaaggtttacttatataaggctgagaaaaggggctttccatttgatttcagttgttttatagacaagtttctagtttgagggagctatttagaaatgtatgtagccttatgtagaaattccaataaagctttcaaaaaataaagctggtatttatattggttgaaatggcaagataatgagtctaaaagattttcccttctgatgttattttttttgttgttcagaatgacacttgaaagatgcctaggatttctactgctgctcttagaatcacaggatctcagggtaaaatcaaactttagaggtcattaatttcaaccagccataaaggtctttttgtcaaacttatgaccattcaagatactttggtgtcaaagtagctcacaagataaaataaatcactcgcatgttaacccataggaggttaaacttttgacagcagatctgtggtggtagataccatgttttctactgtcctattggaaatgagtgttagaggcccatttccactacaaatactgcctagtggctgacttacatggtaaaaatccatccaaccttgctctgcatacattccagaactctaatgcaaaatgatgcctaaaccattttaactctatccatgcatgaggacactaagtaagatgaagcttgttttgatatatacactttttaaaaaggtagaagaataagaggtggtaaaataagttattcaatttattgactatagtaacaacttggctctgattgttaatgtttgtccctgccatgtgatatatagttgtgtgagattaaaaacccccttgggtataattttatttacaccaacacatatattttgaagagatgaatgaccaattctgggaatagttagaagtaaagaatttgaattttctgcagcactgctgcacgttaggtaaattcctctctttgggcctcacttgcaacaccaataaagagaggaagttatactagatgttctataagccccttccagccctaacatgctattagcccatgattcttgtgtagggataccagaagaagatgaaagagagaacctaactcattttctgtcaccagtccttataattcatggcattgtgtatttctccttgagtcaacattgcttcttttagtgacacaagcaagcctgctttctccagctcctcaggaggcaactctgctactgcagaacaaagatcattctcttcctggcactcttctgattcctggtacctgtattcagtttcacattccctttcttgttgaggatgccattgcctatagaaagatactttaggtgaattaccaggcaaacgttactaaagcaaagataactgataagggggactagaatcttggaatttgtgcaaataaattcctttgtgaaactgcagactgattagaaaactgtcatagtaaaatactttaagcatgtccttttctcattttaaaataacaactggaaggaaaatataaatatatcactgaaataatggtttctccatgaagaaaaagacatttagacaaaccaaaagtgtatattctatggtgtagtaaatcattaccttactatattaggttaatacttgataaaaccttgtagtgagataaatggtgatatggagaacttaaatcttcaaatgtatgttttaagccccattatagctattttttttcaaacttacctactataaagttttgtccagagatattccaaaaaagaataatagattggtattaatgtttctgcctcttttactctttggaagacgtgccaataggcaggtaaagagatcaaaaagaaaaagtcgggcagggtgcagtttctcacacttgtaatcccagcattttgggaggccgaggcgggtggatcacaaggtcaggagttcgagaccagtctgactaacatggagaaaccctgtctctactaaaaatacaaaaattagccgggcgtggtggtgcacacctgtaatcccagctactcaggaggctgaggcaggagaaatgcttgaacctgggaggcagaggttgtggtgagctgagatcatgccattgcactccagcctgggagacagagtgagactccatctcaaaagaaaaagtcaaactagatcaccatttacttaacaaggagctgttagtgtattaagagtattatgccattcagtctgattaaaccacctgaaggaacagtggaacctcttcctaatcattcccatgtgagacttcctgggagacagctgggggcagccagaagcaagtagctagagaggactgtggatttctttgtgaggaaatctgaaactggccactttaaggcccctgggttctactgaggttaagcgtctaaagtgtccttgactcactcaatttcaaagcaaattcaatttgatctcttgcctaataataaacactgggcagaagcagacatggaaggatttggaaaatggtgttaaaagatcaaagagatctaaataaactattttgtttgaactagagttaccaagtagaatagattgttttaccatagatggagactctttgagaaggagttaaaatttgtgggagatccccaaaataatggcagttcccacacacacttttcccccagagtgtatataggggatatataccactttctcacctccttttccacttcttatcattgttagatctctagaaagttcatgtagcttctttctcctttgtcgttatatgtttcagatacctcaccagcttcctttgctttcatttaccatatcatagtggtaatttcctcaattcctatatcctacaagagcttgatgaatgaaaagaaggaagcctgtgacaattattttattcaagcctccaaaacagagttttgccaaatgcttgtcctacttctccgtgcgcttgccatggtctttgttttgcctctttttcttttggcagttaccccaactataactggaatttcctgattgatgaagatttagtggtccaaacacagtcagttgtcttttggccagaaggaaatatacattatataatccggtggtttatcttcttatccctcccccattaacttttttttgttttgttttggtttttgaatctctgcttcccttctccatcccctaagcaaaagcataaccagcacgttttttagcatttagtagatacaagcctagcattgtgctaagtattttgcgtctattatctcactaacttttcagaaccatcaatgaagttagttcctttatcatccttattttgtagataatacaattgagatccagtgaaactatagttagcaagtgtaggtgcacatactaaaaccaaatgaatgacttgaaatcccaagtggttaacatttattccagaatactttcctaatctgtgcctggcactgcactagttaatgaaaacagagtgagaaaagatatgatgtgtccagccaggtgcggtggctcacgcctgtaatcccaactctttgggaggccgaggcgggcagatcatgaggtcaggagaccgagaccatcctgaccaacatggagaaaccgtatctctactaaaatacaaaaaagcagccaggtgtggtggcatgcacctgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctcttatagaggtatgagcaatgttctatggcagacaaaaaattagaaagaagacacccattttcctcatagtaaaccaaaaatgatctaaaatattccatgtttgttaaaaagcaagatctttatggttactgttaggcactgcggtatgcctccctggattgtcaataccaatgccatatagatagaacaaatagtttgaaaagacatgaggacaaaacagtctccctgtctcccaaataatagatccaaagaattctctggatttgaatttaatgttcaagagaggggaaggcataaatatataaacatatatgtttcatacatatgtgtatacatatatatgtttcatacatatatatatacatatatacacatacttatatatacatacataaatatatttatatatccacttaaaacatatacaaaactacctatacatatatacatctatatatcacatgtttcaagaagctgttttctactaacatcttcatgtacgtaaaatttaggtgttttataaatttatttgacagagcacccctaaaccttttatatacacacctcatcagatggaagtaatatataaaggaaaggcactggcttcattcttctatttttaaaaggagtgaaaacatttttgcatttgccaaactcctgtgtatgcaaactaattgtgtgtgtgtgtgtgtgtgtgtgtgtgtagacacagcaccatttttggtgaggatggcacaggggctctcaaaagaaggagttctcagaatcatagcaccaaaacgttgtgagtttgcaataatcagagtcatggtgagcatcatggaaatttagaactaaaagagatgttacagattatctccagtctgagtccctgccacacatgagaaactaaggccaagagatgttaaatggcttgaacacagaatgatcagtggaacaatacctagagcttctgtcttccaaatgagttctttttccaccttatcatgcacgttacatcaggcatgaatactggaaatctttctaatgtagggacatccaagcaaaacaagttgcatacatgtcataaaaaactttaaaaaattcagatttacttctggcaaattcattcaggaattcaaactcagataattaaattaatttcttaatattcaaataaagaccagatacacattgacatcatctctcttgtatattcagagtaccagataaatgggatttttcactagggggacaggattgctacactacaccattgccatttgcattcacaacacgggatggcggaagagacattgatacaacattttttctgcctccttcatttttaaatggatggtgacatgcttcacagcagcatctccaaacaaaagatgacaaattcccatttattttccatcagtggtactgtgtgagatgttgtactaagtctaagcttgttgttcctgaggcacagaagtctttttcctgcagcatatagcattactgtaaaaataaccattccattgccagtcactctgtcaggagtattggcagagtgaagaagacttatttgatttcactaaagctattagtttgaaattctgatctgtaaatctggatgggaaccacacgagggaaaggatccctgccagaagcaatgggtcttgtacattctcaaaaacaaaggtcagatgaaaacactggattgaaaatagagccctagaaatgaagcaagaaggaaggaaacttatattgagcgtttgtaatgttccaagcattctgttaggctgtttacattatgtacttgaaaccgtcaactggattcatcttttccttcctttttccaccattgctggcatgtgtgcaagtgggggacccagggaatagagactacaatgtaaaaaatggtttcgctgttatcgttgtcatgttttcctatgtaaaaaataggataatgtgacttttgctgttgatagatgtttcttcaagatcccagtagagtattttgtgactggaaaatttctagaatcttgaaggcaaaaataagtgaaactgtagagaagtgtaggaaaagtcatcaggggttttacataaaacagtttttattaaatctcctttggaagggagaattacaactatctgagctaagttttgttgtgatatgaacgatagtgactgctaaaaggatagcatgggaaagttttttgtttatttgtttgtttttgagacaggatcttgctctgtcatccaggctggagtgcagtggcaggatcacagcctactgcagcctcgacccccacccctaagctcaagcgatcctcccacctcagcctcctgagtagctgagactacaggcctgtaccaccatgcctggttaatttatttatttttttttttgtagagatgggggcctctatattgcccaggctggtctcaaactcctggccttaagtgttcctcatgcctcagcctcctaaaatgttgggattatagatgtgagtcactgcacttggccagcaagggaaagttttgaggagtgatggaaatgttctatatcctaattgtggtgatggttacataaatctatacatgtgttaaaattcatagaactatacaccagaaggaaaaggaacccttcaatttcactgcatgataatttacaaaaataaaatttcaaaaattccagtagtcaactctaagccaataatatgttggactatgtctaacaaaagggatattatttaaaaatattgccaactgactatcattaaagcctaataaataataaaaaagtactgtcactccccacatgagacaaaattgtcatctttacatttatttcttaaaattattctttcctggcatctgtaatcatctatggcttcttcatttcctatgcccctctgctgtttggaaaatcagaaaatagaaggcattttggcattcagggtgataggtaaatgcccctattgtaccttctaataggtcaaatatggtgactttggttggttcttatttttgttatttctccagtcatcaatcgtattgatttttttaaaaacaaaggtcaagcacatgttcgtaggtgacaccagttgcttcagtgagttggtcccttctgcttactgttctggtttaaaccccttgtggcattttctactgcatggatagtggtaaatggggttgatagtgacatagaaatgaacttagaagtaagtttatagactgttggggaccatctgttaatgtaaatgtttaaggtaaaatgcattaaggcttaagagctgacgagacgttttatttgcctcctgcttttgggattatgcctggcacctgcttgagtctagagggttcctggttaaacttgggaaacctggtttcctcttttatctgcagctgttcgttttctgggatggaatcctaagcacttatttgaattgtatttgttgaagtcactgggttatacagtaaaaataaggagtcatgttggtttttgttcgaagttttaaagtatgtaaattaaatacatttatatggctaattgtcatttatggttacctactgttaaatagttgtttaatttgttgtcttcagcattgaaaagttaagcagtatcccttagcactatcaatgtcagtcaagataacagttcatttatttcatagattactttgattaaaatcactattaaagctatttgaattatattataattttctggtgatgtcataataaagaagtttttgaacgtgcccattttatttttaacgcttcaatgtgtattactggagaagaaattgaagtaacatatttttactgttaatgggaaaatggtcttcttcaaaaaggaaaaatcaaacttacctcctagatataaatcaataattttcatttctagcattaacttagtagtttaatgacttgggcttatggaatgattttttttagaccacatcagacctacccaagggaaaggaagcacaaaaaatagggaatgatacgtagaattagatggcgagaagaaacgaggagagagagggaaaaagtctgaatgcaagactattgaaataagtgagtaacacacttttccagaaaagattcatattggagttttctagaagcctctgagtatgatgaggaaaaagaagtgattaaaatttgaatggtttccctatgggcggataaaactacctgttcagctggaatgattctgatgaccttgcctctgaagcttatcctttgagatcagcaaaaaagttcatgttctcatctctcatttgagctggagttgattgatgcataattaagatccctaaggaacaggtgcaaaagctgcagcgcttctagattcatccatttctctctactttttaaagaccagtctcatgattctaatactataaacacttggtggcttggtattgggggcagagagcttccggtaggatgacatgagataggatgtcatcctgccacagggaataaattcttggatgaaattctacaggtcatttagcccatctcctatattgcacaggatagggagctggggactcctgaggcaaagtcattttctcaaggccgtgtatctggttagaggcagaggtaggaaggaaacccaaatctttctatttttagaccatttgcctctctactaggccatccctcgctttaacttgggatcttaagcttcccttgtaatttcttgagagtaggttttaatcttcctactgtatgctctagaaactatatgctgggggaaagctgaggggatagcatagagtaatatccaatcttgaatcctttctctcattttaaattgtggtgttttaaattagcataggtaacatagagattattactcagttgaccactttgcacttgatctgagggacattgcagagtcatcacagattcttgagttatgaggtcagtatttaatgaaaggatacgtcgaaggcttttccttaactttcaaggacctgtggggatagtttctactcaatgcttctttttattcgctttcctaataaaactaatatttaattataaaattaaaatgaaacaagtttggacttccgtatgaaaagtcttatacttgatctgtaactacaagatgttagatgttcttcatggagatgacaggcaaaggttacttttacagttctatgaaagtaaaaagcttttaaaacatttgaatgggaattggtaaaagaagcagttcttaattatgtcaattgtctgtaagagctcaggtgattatggtaaacacacctgataacaataacttaagagagcaacaataactttacagcagacacacctgaatgttggtgggagttctgagctaaggaacccagaagtggccaacctgaagatcaattccttgtctacgaggaacatctgatcccctggcctgtcccttggaacatgggccatacaaggagttgaggccctttgttttggattaaatgaaggtttccaagcggacgtggttaggaggagggtactaagtgaaaatgtgatgtaaactgcctgccttttgcaagtggttctcctgtctagcctgctacctctggactctctcccctgtatgcaaggccccagtaaaaccccaggtctcatttgctggctctgggtctctccttcagcctcttgaacatgctgccatccccggtggagtcaataggaagtcggcacaacagacaaggaagagctgtcaccttgcctgataaaataatattctaaaggggaaagtacatatttataacaactggcaagccttatgacttaaatgaacagagctctgctctatggaaacacagaaccaacagtgccaggtatgaatagggaaaacttcttggtagtggtgataccttattagagtcttgaagagggcatatttcctggtacagaaaagggggaacactcaagtagaagagtaaagcagaaaatatataactctccattttctcaggaggtctaactcattacagttccatttaacccaatcaaaaccaatgctcccctttccctcacatctttaccgcattcttttaaagaagcatacgcacaactctttgagcaagaaatatcaggcaaccgctgccatcttagctaaaaaatcttttatgtttgagaacttacctggaagagtcctctggagagagaataagaagatgctttcagttgcacttggagagaatgtgagaattaatcgcctgcttgtttgggaaataacaactagttgtttctggttaaagcaacaccagtatttggatgagttggagcaacgtcagaatgattggaaattgctcaaagctcacaatggtacttgaagtaaaaggatgaaccccttcaagaacaatgctaggttctcctttgctacatggagggcaatggcgcatgataggccagggagaaaagaatcaccagatcctttgcctacttctgccaaatctgttgcaatgtttcagataaatcacttgaactatctgagctttgaagtgcttcagcttccactcaataagaaaaattgtttgaacctctctcattctgctcaccatcttacccttctccttgaagatcagcttaaaataaagtgatttgaagccccaggtgaaatgggagccctttactacctcctgctaaaggtggtaaatgactgtgcccaactttgacctcctctagttagcaacatcattctaaacttagcccagacagaaaaggatgacagcaaaggtttgaacacttttaaaggcctctccctttccccagagttcttatatatctatgtatatgtgtataatatgtttgaatattttattataattatcctccttaagaaaaacaaatttcttggattttccctatgacttgggcttaagaagtctcttaacagttcctcagatgtagtacctgcggaagggaaggattaggttagaatatattcaaagtttgtataaaaaagagggtaaactagtcatttaaatgtaaacatataaacacttactttttactgtgttggctttgatattctttaatttctttgttatatcagccctttttttatgtcatgttgaaaatgtgccttcctggttaaaaggatggatatttggaaacaaggcagtttgaatcacagcacaactatttaattttaaaagacacttttttctaacctatataattcttaattgttctggacatgtaggctatttcagtgaaatttagaaagcaaggccatttcctacagctaagccctttaatgataattatgacaccaacccccaaagacatggtttcatggctaacagatcactctcagattttgtggggatagagtgttggtagcaggaagcggcagaggaattcaactccttcttgagcttcttgtgttttataatcctccctatgtcccacctgttttgtctcagaggggataagtcaatagagctgctgctgttcacaaagccatgcaggtaagagacatgtaccccttgcttcaaagtcttagtaaacttatagagaaaatatgatttgattgcctaacaatatatttataatttacataccaaataagtgaaacgtaaggaaaaaactgctttgagctcccgagaatgctagttgatagcaaacaaggaaggtgctttggtaagaaggttgtttgctttgagcttccatggatgagaagaaatcaagtaatcaaagaggaggaagaggaggaataaaaacatagttgagaatggaacagtcagagacatgtgggcactatcttttcagataggaattttatctttcttccttgttcaacagttatttcatacacgaatgagaaaggccaaacatagtcatgaacgtttgcttttttaccttctgcctcttcagtttttcaagaaacactaaactcgcacctaggaatattttgacaagcttagaaactttttcaaaaaataactcttgtatatggcaagatgttactaaaatcagattttttttttcccatggagacgatgactgcagaacttttcattcacaccctcaaactcgtgcagagagaagccaagatctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacaccttctctttttaataataagaaatgttggctaagggcttgtctttcctggttctagattagctatgataatactcatccccttatgcagaaaagctgcttttagacttctcattgcttcccagttaatataacatagggattattaaagtctctgagtatgcatttctagatgtgtatagcattagatgaaaattccttaggcctttggaaattcttcctttcccttttagagaagaagatattatcctggctatcatacatagcaagttatatgcatataagataagttcccttttgccatgaaatcaatcttccagttacaccctgggtttgttctttcttttctcatcttgttcctttgcttttcacttctctaattttacccatcaagtgatcatgcatctgtttttcaccttgccctacaaacctctcttagttgctttattctccttccccagtgcttctgtcaccatggcttcatatctggccccacccctaccccatcctatgcactattcaaaatcttcattcccagccatccaccaactgtcagcagaagaaagtccaactctccagcctctttagaaagcagactttattccccacactacataatgcatagtaggggctcagtgataccaaatatgcagatcacataattaagtccatagcactgcctaaacatacatggtatttgaaggaaataagtcctgtcatggatgttgactgaaaatttcccagcatttacagcctagaatttttaatggaaacataaagccccaaatttggagataaaggagctacagaaaacagcagatgtcccagagcacacaaaccatgtggccaagagcaaaagggaactcacaaggaggtgtctgtattacgagaactcgtgcccaaattccttttctgtgagaaaacagtaccatataatccttttgtctcagtaaaaaaaaaaaaaaagtggtccaaagcagacagaatggaatatgcattctccctcctttacccctaaaacattctgtcttgatcaatttcatttttttttgtcaggtgcactagatgttataaaagcacttagcttattgcctggtacatagttatttgaaaaactttgaccatggaaaaggctgaagaaagctaagagtattctatataaggtctggaatgtcaagataagaaatttgcattgatctaacaggtaataagaagctccataccatattctttttacctgtatgtaaaaatcaagaggagttaatacaagtagtattttattaccaaaatagaagttgcatctggctcagactcagcctctgattcctcaggaggtttttcccacccctttccctattcctgctttccagctgatttgaccgaaggacagaaggattaagaaatcaagtagcttatctgagaggttccccatggggcgctttgtcccaggtgttcctgcttggagcttacataatcaggggctttctgcatgctgagggtattattgtaaaggtgattgtttaagtcagtgggtgacggtgtcaggataattatagccaggagatatatgatcataaagacctagttagtaccccaggagaccccaagacagggcttctgcccatacttttgcaatcacacattctgaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctactgatctagaaaaaaataaagttattattaaaaaggaaatctaaaggatgataaattagctgcatatttttctgttcgtctattgttttctattttctctatcttaaggttgtttataatagacagttctacatcaaacttgagatgaaattaaagttgtgaaagatttatgatgtgtgttccagttatggccaccagttctaatatgcagggaacacgtttgaaacgggatcacagttgactattaggatacaggactattcttttcagcagaactaaagagaagatcagagacctctctattttttctctccctgcctcttcttttgtaatcacatgattaatacatgctattgaaaaaggtttcaaaatgtaatgaagaatatcaagaaaaacatagaagtcctttctgactatctgcaaccttagtcgcctctcaagtgggaaccactgttaacatttcaatgtgcagatgtcaaaaaccatttgctctgactttacaaacaggaacgtgcatgcacacacacacacacccttgccctaaaagttttagttttaataaatggtgtatacagtcaacatatgtcctggatatctctccctgtctgtacttgtagaaatatgtaagttccatttaaattcaaagtcaaatacaatttgaagttttgctgaagcttctttctcaatacatgcttctagattgtagtgaataagtgactgaaatcagctagccagtttctaccacaacatgatagcttggttttatggctaaatgagccccaggaaggagtgtgagaaactcccaccttgctccattgttcatgaaggacttgcatggtgagagacccttgggtctcctttcatcccagttttatagtaaaaagatcaaagatcttccccaaagtctctgcccaactgggtccccaccctgttaccttctgaggagtctaaccctgagtactgctgggctttgcagatcctagagttgcgggttatgagtgtgtccagagaaccagagtatgtcatctggattcactcactcattcacacattcatttattcacactcaacaaatatttataccattattcatagggcagacagtgaacattaaaaatgtgaaacaataacatacagtccattcattgtcaaaggatactacagatcaaggaaagaggcaacttcaagaaagtatgattagtacattgaccagccaaatgtagaagcttctgtgtcagacttgacagggtgagggaaagcttcctggacaagaagacatctaattggaatatggaaggatgcttagaatctagccaggtgtggggacttaaagggtaaagcaagtgctacccagaaaacgtaagtaaggcagatctctttggcctgaagtcctcatcaaggagtttaagctttattctgagagtcatgggaaacaactgagaaattttaagaagcaaagggacctgatctgtaagatttatacaatggagaacaatatggaaaaggaaaaagacaccattaggatgctgctgcggatgctggggtgagtgatgttgatggctttaactaagggaatggccctgggaccaaagaagtgtgcatgttttcaaaagtcatttcttgctttctgcgagcgagcctactaaactgcctaagcacaccggttaagtgtggcaactttgagaaacagcataaaccatgggtgacattgcaaaactgaaagcacttggtgcagaggttagataaatatctgtttctagggggatatacatgtgtgcattcattgttttgttttcaagagacaattgtgcctgaggctggagcttgctcaccctatcttttggactcagagtatggggcctggtctattttctacatgaccgggctttagttcagaactgacgagtcatatatcattctgattgattttttttttcttttttctttttttcccctctcaaataaaggggttgcaggggtgagatagagattgctatgaaccatcagggcaactcaacccaaatatgcatttatcaggagccccctaagtcaagctctcctgtcctcacttggtttgtctactcagagctgagataaagaaataaagggttaaatgaggtcagttagtgggtaaaggacagagaaaatagatgaacagcccagcttggactgctctgatctctgccggggagaaatggttagaaggggacatggcagagttacaggattaccaatcagtgtcctaagcagtggggtagagctaacccctgaattgcctaccgtggcttaccttgcttctgaattcttgggtttggtttcatctgtatcctctgttttagccttctttttagtgccactccaaaggcaaggaccacaaagcataagcatccatttttattaaagcagaaaggtgaagacttaaaatgtgcttctgtatgtgtgcatttttaaagcaaccctttgtaagaatgagtggatttagcaaagtagatgcgattgaatcacaatggaatacatgcctcttactcggtctaaagtcccttggttctgcaaagttttttattctcttttcaaaccttatgcaattgtgacttcatctaaattattgatacagttctaagggattagtatcttctgacggcagtctgttcaatatatttgtattttttacccttgaaggaatatgggactgttagggttttaaaagaagtctgagtttttgtttgtttgtttgttttgttttgaatgacagtaaatatccattaaaaagctgtagatttgcagccttgatgattagctctctcttagactccagcaagccttactgaatttcctctggagatcaagtattgaggggcaaaatactggggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcagagattaggagtattcataatttctgactggcatgcattatgctaatgtggctgtcctctgttgtatgcttctgctgagacagccactttactcctgcttaattttctccctaatggtagcagtagggacttgggtatctacagtgagcttttaccaatttaacttgctgccgctataggccgttataaattattattcttatttagcacttgaatctataatttctttctttccctcatgttctataaaatatagacttagacctaagttagctatgcttttcccttcttataaatctaaatctttcatttgcaacgagctaaagttttggatgctcaacaactgtaacccctgcttggcagactagagagttatcaaggaacttcattcattcattcattcattcacacgtgcttgccttcatacatttattcatctctgaatgcaataacatatttacagagcacctactattttttttttttaccaggcaatgctttaggtgttgaagataaaacagttaacaatatcgatttgtgggaagaagtactacctataatgtctagaaaatacatgtgagatttgaagaaaaatagcttctccatactgatattctcaaagtagtttttctccctaattatctgtacacctccactggaattcttgcgaaggttactttgccttctggattttgaaaagttgtctttgattttattactttctccctaatgtcctagggaaaatatttccttccttcctactgattattgttttagaatttgaaaattactggaaacctatatatgagtattttgttataaaaattcatgtgcatttgaacaagcacaagagtacttcctatgctggatgctagattctagaaaattttaaaaattttttaccagtctcccagttgtgatattcccagttagttaattgctttttctgtctctttctgtttcttcctgaggcccctcctccttccctgcctctctcttttttgattttttaattttattctattcttttttttttttgtagagccagaatctccctctgtcacccaggctggagtgcagtggcaccatctcggctcactgcaacctctgcctcccgggttcaagcagttctcctgcctcagcctcccgagtagctgggattacaggcacatgctgccacaacctgctaatttcttttgtattttagtagaggcggggtttcactgtgttgcccaggctggtctctaactcctgagctcaggcaatccgctcaccttggcctcccaaagtgctaggattacaggcatgagccaccgtgcccggcttccgcctctcttttttttaatgagcaatcataagttattatcaactagcatgcaggtaataattttcttatcttgttacttgtgttccaccactaataactatgagactgcaggcagtttttaacttctctgagccatggctccttccctgtagaattatgcagtacttcttgtgaaaattgagataatgtgtaaaaataaaaaaaaaaaactactagcactatatcagccaccatacttggctctcaccagcattctctgtgacccaatcgccagagctctgatacttattccagactcctggcaccatgtttctattgctgctgcccatattcccctcccccaacagatcccaatcacccttcttgcttgagcctattgctcaagctttctgttttgcctttcatacctgtcagttctaaatcttttccaggtattcttgatctctcatgtcgaccccattctgccactgacaaatctagttctgagagtgtgcttcagagaaatttagatttttgagataattttgatatatagtaatgagaatctcagccttatggcagcctttatgctttcagccaaggtggaatcctggccaaaatgattttttttttttttttactttctgccatggtgcctggaatttcttcaatatagactcatttcttagctcttcaaaggcttccaggtttttagattttccttctaagcctcaaatcctgttggtcatcaccctaaataatctatcacttatcacctgcaacatgctcaactgagataggtcttgtagaaatgaagcatagcctgaagttgagaacagaagaaacaggaggagaaaaagcaccagaagcaaatttattctcatatcccagttttgagaaaagctagcctactgtaaccctaggagtttggcggctgctaatatctaaaaatgcgctggctctgtagcttggaagaaaaagaggaacagccattctctttctgctttccaagggtaagcatggccaacctagtatcctgctgtgcaccatgaagcatcatcaggtgcagattaggaaatgaatttacattaagtttcaagaaagaatttctgacaatgtaagctgaattgacaagaacaaagttctgaaggaagaggccaaaccattactgaatgggtgatttgtggctgaactggatgaaccgatagcattccatggctagaatttgtgtcactggttcattctgtgtttcctcttattttccaaattgcattcaatcgatatggcagaaatgaatacccctatatacaattatttcaatatatcttatataagtttagaaggtgaagcctgtatatatttttcatgtaaatgtagtattcccctgcaactcagtgcaataactacccacagtgctgatacataggactctctcaatttgtcccccatgtcagaaatgctgtgcaaaatccccatagctgactgcaaaacctgccctgaagatcaaataaatgatatacatacgaattcctaataagtgctcagcaggttgtttgggcttatattagtctcctacagctgcctctcgggaagggataccccaacaaagtgtttgttaatgcttgccacctttagagaagtctcctgggatgctgcctaaacctacactgtaagcaaagtggaataacaagccctttgaaaagtcacttgggaagatgacaacccataatggtcactttggctaggatttaaaatgctttattattgtcgaattaaagcaccctggccatattgctctggatataccccgtcttagccaatctcaggtttacaatacaagaacaatctcaatctgatttgcttaatgaaaatgtatccctctactttaaaacagggagataccccagttccttaaaaatatatgttttattgcatatgctttaaaaaacctatttacttagcagtttcattttgtttgcagcctcattgcattttcttctctaattagcagatacatgcatcatctcttggagatgaagcaaatatttttcttttcctcattgggtagtttcccaggaaagaagctcacggcctcactctggctccgggtttgctgtgtgctttcccacacattctcaccctaccacacttttcctgtaatgttgctgagttcggctaatttagatcctttctctaatttaagttgctttcatttaacttggcttgagagtgtctgatacttacactcacaaacaaaactatagagttttagaactcagagcagtgcttcccattgagatttctggatgccacaatggtgcctgcaagaggaaactcatcggagtgctttcatcagcaaggaactggaattcctgaccagtgataagacaagatgactgtggcagcttcagatatatttacaatttgacattcaaaggccaaaggggaaaaaagatttttcccctgtatctcactatttttcagggaggaaatttttcagacgcttcctatcccacccaacctccagtagagttctccttaggtctcattggttaaaattggatacatagtcaccctttaatcaatcgattgcacaggaaaattgaatttccatgatgactatagcctaatcatgatgcatgtcctggggctgacccattttcctgagcacagaatttgttcagtgtaaccagtttctgagctaaaggaaaattcacttaacaggtagagaagaatagatgtgagtaggcaaccatacaatagtgtttgttttgaggacaattatgagtaggttttttagatacattgtatgtcacttgcaagtgtataagcagagtttgctatttttttgagatattttttgagtaactgtcatttctttgtgagatttaattctagaccctaattctctcactgcacagagagggagaggcatgggcaaatatatgggattcctgagggaaaatgtaggcagaggggtgtagggtggccatacaatttataacttaaagcaagacacttctgagagtcaaaaggagagctgcgaataactctaccaagtcaacaggtataaattatcctagacaaactaaactgtatggtaaagtcagatttatataagggagtatatttttaaaatgttatggggaagctaaagctaattttttaaagtttttgtaggtggagaaaatgccacctttatttaggatcataaaaaattccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaatgttgatcattttgttttacacaatgcctgtgccaagtcttcctattgtcttcctcaaggcctctaacttgccaggttttagctatcagtgatattagtaagaatctttttggtcttggccgtgatggaagtctgaaaaacagcatttggcaagggaatgacccaaacagaataattttctatagacaaaatgtgtttaagttgatgaatgaaagatgtgaatgctcatgctaggagaaggggaaaagcattggtatttcccttaaagagaccataccagggtattttatttcctgcaagtggtttaattttgtacattgcttctctgctcacagaatgttctctgtctgtcataataaaggagagccttttcattgaaatagacctctgaatctgttttagcgactgcagtgacagtctgtatgtatctgaaagaatgagaggcataagacacctacacatgttcacatctagggtagtattttcaaaaaatggagttactttgaatccccgatcgtctctttcttttactcaatttcaagttaatatctaatgtaaaacttttataaatagcaaagagacttatacttctctagctttgcaatatttagtcttgctttttcttgttggcacggtgtgccctttaccaaatgatccatccaggtgattgatactaaaacatctcattgatttcaagtttacgtgtctagatattagatcctagaaatgagttgttaataaatatcagctttacatcaagagtttaacagaaacatattcctgaacaaatttccattgccttctaaaagggttatttcttggtctgcagagctgctaatctgtaggttgcattcagtctaggctatcagaatagggcaccccatgggacttgatgatagtattgtcacttagatggcaaacaaggcatgaaataccttttcatagaactaaacaccctcaaatggggacatgaaaccctgtacctctgggcacagtcaaaagttgctgtattaagtcatgtgtttccggtacttctgggctcattaacccacaggttgtttcttgctcccagggatcattctttttggtccaaaactaaataaaaaaaatagatagatcttatggattgatgtgaatgttgaaacagaagctctactactaaaatagtggttcataattaataatcccttgatctttactttgtttttttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatgccctgtgttgtctgtttgaagtactcccactccaggtgtgttcagtgatgtgtggtcagcaacgctccctctgaccacgagacagcttctgcaaacatcttctccatcctgtgtgcggcatgaagccagagcactggactgtgctaccttgatatttgctgtgggttgaattgagtcccccaaaaggatatgtcaaagaagtcctaatcccttgttcctgtgagtgtgaccttatttggaaggaggttctttgcagatgtgattaaaatggaagctaagatggggccattcataagatggagagtattgtgggtcctcaatccaatatgactggtgttctcaaaagaaaagaaggtaaacacagagacaggcacagagaagagagtgccatgagaagatatggacacacacagggaaaaatgccacgtgaaggcagagacagaggctggagtgatgcatctacaagccaagatatgccaaggatcactggcgacatcagaagctaagagaaagtaatggaaccaattctggagctttcagagagagcattgctctgctcatgtcttgatttgagacttctggtctccagaactgtgaaaaataaatttctgttgttttaaaccacccagtttgttatggcaaaccctaggaatataatatagttcccttctgccctggtatagttccttacatctttctcacccaaagacgtgactaggatcatttaacctaattcccctctgttgagtatttgagaacataatgagaaccttcctaggactggagaagataaagaaaatgctacttcaattttatatttttcttgttatctcaccctgctaagcttacattttcaggaggcaagtaggtattgacagttcccaaggtcaaacttcctggcctcctgactttgttcactctggcatattcttcatgtagaatgtctcttagaacacaggcttttcaattattttcagtaaatgtttactgagtacctcccatgtgcaaggcaatgggaaaagatagtctagatagtcttagtcttcaatgagccaacaatccagagcgacatatagagttatgtaaatatatttaccaagtgttagaggagatcggtgaaggtgtgaatagtttttataaggcaaaaggagtggtggtgtcataaaaatctttacctctaagggttattttgaactgtgtcttcaaggatagggaagattatatcaggccaattaggcaaggacatcataggacaagggaatattatgataaattacatggtaggtttgaaaagaggggttggcatgcatgattaaattataggtggggtgaaaaaatggtagtaagtgagaaaaaggtgaattaagatcaaattgtgaaaaatttgtgagtgcctacaatgggccaggtcctcagctaattatttttaatacattgtcttgtcaggtctgagaggtaaatagttgcattacatagtggataaacctgaaaataaaatgacatgagtaatttgttcaagaaattcagatggcaggtagtcaaggccagagttcaagcttggcataagtcccaagcccctgttcttctctgtacaccttgctgcaaaagtaaatggggaatgcttcagggctcttgagaaaggtagtggcaatgggttggcccaggtggaggattcactggactttagaggttatatgcagagggctgtggcaaaacaggaagaaggtgatttgggatttaaaaagaggaatcctgttggaaaggaggggccatatgtacttaggtttgatgatcaattaattgattgatggttgaagggaataagaaaatagtgcaatgactgtaaggttctttgtttgagtaatgatttgaggatggtgccattaccccaaggtgaattagagacaggaacaacacgttcttgggaaaagataatgagttcgtttttagcttctttaagttttaagcgcctggtagaagatgtccagcagaacattctaaattttggcctggagttcgggagggaagttggggccagagatccatttgtgatttatcaacatggtaggacagccagtgacttttactgaaatacaagtctcatttctgacattccattgcccaagttcctgcaatgattacatgaagctattagggaataaaaaaagacccacgttcttaacatgactttgaggtattgtttgatctgggcctgcctgtgtctccagcctcattttgaggtatattctccttctgtatttcagttctcaaatgtatatgtgaaggtcctttctgacccagttgcccgataccagaatgccttcccaacatacatacacatctgtacacaaatgcatgtgttcacaccaacacacatgtgcaaatctgcacacatacatgcacatctgcacaagcaatagacacatgttcatatgtgtacacatgtgcacacatatgaatagattcatgtgtacacatgtgcacataaatacccatgcctgcacatgcacagatgtgcacatttcatccagtaattccaactaattcctcagattctcatctgaaacgtttttgttatcagggaagtcttctgtgacctcacagtcaaacaagtttccctgttccttctatgccatagcacttattaaattgtgttgagtatttagttttctgtcttattagaatggaagttccatgtcaataggacatgtggaaacatccacatatttcccttcctctggcactctacatggcaaaagtgggcagtagtctttgtatactacaggcacacatgaatgaattcatagacgaatggatgaatgagttaatgaggctatgagtatagatgagatatagtaaacaggtagggggaacacagggcacaggaatatcctccccactccacagtggacttccagcccactcgttctcttctatgataaagactatgactctggtaaactttgaagtctttctttctaacttcttgacctctaaaaggaagttggagttttcattaatgccgtgggtcaggctctgtggaaaatacaagaggaaaaccagacagtcctttctattagtgtctgaattatctcattaattgataccaatgttgaggtaatcaacttctcattaagacttctcattagatggctatttctctcttttaccttctggcagggagtttagagcatttaatcatcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagattttattttgccaacactcattcattgtatggaataataattcggcagttttcatgatatttcatgtctgggcccagttgctcctttggccagaatacactgagactgaaatagcagtttatttcttgcttaagtaatatggttttcttgtgaccaaaagcataggaacattttatttcaccccagacagacacttctcaggtttgtgattttaattataacaaaaactggatgaaaagaatgacttgatcatggcatagatatgccaccatcagaaaaaataatccacagacagatcaatagtatcgttttcatttatgaatactattttaatgtcttatgcacaggtattatctctacaaaccatctcaagccaaaaaaagaacttcttcagtcacacgtgaattgtctacctttccataaaaatgttctgtcaagagctttctgcataaaagagtaaaaattttcaaataacttgtaattttttattttacacaaaatatctgggctaaagaaagtacattaaagcaacttgcatctcaaaacaatacatttctctggttgaagttttagtgaaaatcgatttattcctcctctgagttttacccaatgggtaaagttgtctaaatatgggattccttagaatccatcctccttcccaagcatttccccatgtttccttccacccccaaattcttaccccatttcaggcagagctgagcaaacataagccttctctgaagtattgagggaaagtctgctaaacggctaaactacttaaggagctaacagaaaaggttgtatcagagaaacagtggagaaacacaggtttctaattatatctggcactggagagaatgtcaaaggtactgggcctggggcaggttcacaagagtgaaagtaagagatttaaaataggttctcaactcctgataaaaacacgaatatttatttatttagtctagcttttctttcttctcttatcgttatgattattattactactactacttttctgacttttcttttcctaacctactagtgtttaaacctcccgaagacagaggtcagttctgctttgatcaccactatatactcaacaattaacatatattgggtgccgagtaactgcagagagactgttctctatagttttaaacgttttgaattaatctctccctattctgtcttctagcctcttttcttccccttcagtatggtagcatagactgtcttttccatgttcttgaggtcagtacatttcaggattataatctctcagatagtataatatcagctcataatcttccaacaaaatggccttggatgacggtaggtagcaggatgaagagagtctgcttggactgaaacccaattcaagagttggaacccatgttggcagtatagatgttttatcttgataatatttctttctttcaatgaaatgaaaaagaataagccagaagaactgctttacccaagcccagattcttcaaatgtgctttctcttgattcctgtaggaagacactgaacagaattctgcatttctaagaataaaaaagaaaaaaaagttaagtgcattaaaaaaagagcaaaacaaagaaaaaattaccaaactaataaaatagtacagttggactacaccaaagggaattttcatttgattctacataattacttcaccttactctcctctggacacatcatataatttaaatgaacaaattttaaaaagtatctttctaaaatagccattaatttggggactattatataaattttaccataattgattgtgtttagtacttccctatacagaacattcttttaataagatgactgaaaggcttataaaattcaccaaatagaatctctttatgcatgataactggtggtttcaagcaaaagtatataggagtgaatatttaaaatgaaaacaaccagttaatgaagtatattttgctatttatttccaaataaaaacaagccttggtgtctaagacttagttaactaatttgtgattttttaaaaaaagtatagatgaaaaggtagctaggtagaaatagaaatagcttagaaggctagatacacagatggcttccttatgcagatttaggaagcaaagtaaatttatactaactaaagaatatgaaaggtaaatgacaagctctatgtatcatgactgactatgctaattatagcttataatattctgctggacctaagagccctcctcagctaaaaaacaccataaagttcatttaatacaaccttcatattttactgatgagggtactcaggacttgagagagtagagagcagacacacctacttcctaaagccagtagtgtggtcttctttgaggacattgaagttgagacatgaaggctgagaagtggctgatcatgtgatgagtatgtgaactttgagggggattaatgcttggcagagggtgaaagtggcatcaacaaaattggtaaggcaactggccagactgccagcatcgaaggccatagtaagcaattaagatataattccaaaagctatggaaacattggtgggttttaactgagggaatgatgtaatctgatttatattttgaaagggtactctggttgctttatgaaacacggattgtaagggagggagctagagaggaaaagggaagattacttagaaggcttttaatagggaggttaggagaaagtggaaatattggatgtattttttgggtagtgctaacaacatttgccagtggttcttggatagggaggtagagagagaattaatagaaagggaggaattgagggcatctactttctttttgacttgaaaggctgagtagatgatggtagtgtttgccgagatggagaagactggggtagaaacagaaatatgttttaggttagtatttatattttatttgacttgtattgcctaatccaagtaaaaaaagattaatcctcacctagagccaaatatatattttattttagtcaggaccaatataaatgtgccaaaggaaatgattaaatatggttagtatctattccctatatagtaaacaaaataataatttaattttcacagtggtcagaggccatcttaggaactatatgtgaaggtagaatttgtgaacagggaaggagtagtagctacgtgtcactgtgttttatatgataagtgtgtatatgtatattaatgtgtatggggacagaatgtccctatgaacttaggaaagtgaattcccttgggttagaagacaatgtaaggtagccctgtattttcaagggtgatttttagaaaatcctaatcatttttcctgaagtactttgtgtgaatactcatgaaattatagacagaccaattctcttttgcttagaatgaaaatcatctgttatgccttcatcatcagtgaatgttttgggaacttcaagactatatccatcatccagagttttggcacacacacaaaaacatcgtttgtgctagccttggactttgctacctgacaaatatagtaaagcactcaatggagaaccatacattagctggatatgtaggacatcaaacttaaatgttatgtaatagctatgaagggcacagtttctcttatagttttaaacattaaggagtactgtctgaaacttgaaacttaaaattaaaactagtaaatggcactcttaaactgtccacatccatggtaatcacagttcaatacagcatacttttttgaatgccaccaaatggaataaaatttttcctaaaatgaatgaactctctgcttctagtttaatatagcataacaatacatacatactcaaaaataacttgaagggagaaagaaatttttcctttctagaagaaggggaggcaatttgtgatgcacagtagagggaggagaaatgagagaattaaattttttacgctgctgtcagaaaactgggagaaagcttaaagagaactaatggggagatatcattagagaaaacaaaaactcaaactaaatctctaaatggttgagttggacagcattggagcactcatttcccttgtaatcactctaaaaaataggctactgtctacgatagataatatgacaatttctgttcaggtagagcgtactatttcaatgtccaaagacgttattcttttaagtaatagatgttcagtgaatgttacattggtttttaatggactttccccagttggttgcttatttcctgatatttttatgttgtgtattcagaagagtgtggactggcttcagctaatcctcataaattgtctatccattagcagatttaaactggacttggggctgccatgtttgtggattcagaagtagccttatcaatcaattagccttatcttcttgtaagtttgatgattcactaatcaaacttagaagaactagataattctatttctaatgtttttatttgttgtattctgtagacaaatatttcagaataattttctccaaaagcctgagtaaacaaaggaaaaattttcagcaaaggcagaaaagtttaaaaacttggcaaggaataactcagtatgacaatattggtgaaccttccttttattgtcatacatgaaggaaatgaatatttaaacagattttttccaggcttgtggggatttggcaaccccaggctctgtctgtgataagatcttactggcctgagagtcctgcctagattcattaagaatttctttctgtctctctctttcatacattatatatttttcaggtgaccattttagcaattgtacaagctatttttaatattaaattatgtagcctcagctgcttataaggagagtttaaggagaatattagacatatttataagtatcgtttgtcatgcaagggctaattaaccttgaaaataagcattggcctaccttcccagtacctacaataaagcacactaggccaaatctctatgaggcggtagttttctatttaaaaaataataataataaggtataaaaagttactaacaaccatgcacttgttcccctcaacttaaaagttaaaaaaattagaaaagaaaggcaacatggctaataagatatgtaaattaaaaatttcctactcttctttcatttgtcactatgttttgtttgtaggtagattcaaagaataccatacttgtcatagacaattatttgtattatgttatattattttaatttactcagatctgttgcaatgggaaaaaaattcaggaaaaacaataactatcaataataaatataaaagcatgcattttcgtaacagaaaaactgaagagagttaagacacattgtacgttccaagagggttggaagaacacacataagaaactacaaagagcatctgcgagacggcttgtgtgaactgatggtgtgggccaaccttcaaattgcactgtcctctacaggtcctttctagatccattcctttatcatctcaaatgatgtgcagtaataatgctgcttgcagaatgaactgaattatcatctaccaactaggatgtgagttccatgaggacaccactgtcacttttgtctttttattcattgctttgttccaaaagcttagaatggtgcataccatgtagtagaaacttaataaatacttgctaaatagatggatgcatttggcatttgctgttttgatgacaagtaatatggtctatagtttagttaatatgatgcattaaggtcaactgcctggtttggatcattgttctatagttatgtaaatgttaacatgaggaaaagatgaataaagggtcctgggaattcactatttttgcaagtcttctttcaatgagaaattattattttatttatttatttatttatttatttatttatttttttattttttgagacggagtctcgatcagtcgcccaggctggagtgcagtggtgtgatcttggctcactgcaaactgcacctcccaggttcatgccattctcctgcctcagcctcccaaatagctgggactacaggcacccgccaccacacctggctaattttttgttcttttagtagagatggggtttcaccgtgttagccaggatggtcttgatctcctgacctcgtggtctgcccgcctcggcctcccaaagtgctgggagtacaggcgtgagccactgtgcctagccagaaattattttttaaaaagttttttgggaaattgagaatggagaagggaaaaaggagtaaggacatgaaaggctgaggaccattgactctggaatagtgcaggaagacaaggtatgggcaagaaagagctgatgtgagtgctggcaatttgcctctggaaggccaaatagcatttgactactactcaatctttttggaaaatcttgaattaaaatctcaaatactcactgtccactgtgaaatttcaatttcatcagtattcttttacctgtgctgcttttatctatctgctgatggctgctagtgctagctgcacaaagccctgagttctagaccttctctccctgcttaaagtttattaacaagggctgggcacagtggctcatgcctgtaatcccagcaccttgggaggccgaggcgggcagatcacctgaggtcaggagttcaagaccagcctggtcaacatggtgaaaccccatctctactaaaaatacaaaaattagccaggcgtggtgatgcatgatatagtcccagctaatcgggagactgaggcaggagaatctcttaaacctgggaggtggacgttgcagtgagctgagatcgcaccgtggcactccagcctgggtgatagagagactccatctcaaaaaaaaaaaaaaaagtttattagcaagtataaatgtatcagaacttaacaggtcaatttcttgtattattgtgagactaaaaaaaattgggaaaaaaggaaagctttgaagagaaaaaaatgggtagccatcagaatcattttgtgaaaggaacaaatactaataagttaatctattgttctcaacaacctgttatccataataggaaaggaatccagtatgtgcatgactaagttaactactcaaaactttcaaaaccagaagccaaaagaagttatagtttattttaagcaatatccacaaaacctaatatagtccacttctgagtaatcatttaattatggtattctatcattttatttttaaaaaatatgctgagtacataaacatgactaaaatatcaacacattctttcttcctacacataactattaatcttaaatgttccaagagaagatgtttaaaaagtaaccctttgcagaactagcccttctctctggagctgtaggcctctcttcttcccagccccctccttttcttttcttttatcttactcgtcaccttgcagtcatgagtattgtagcatgtaggagtggactgctgagagaagggaagaaggatgcattttgcattcacttgtacatcagccttgaagcctggctggcggcaatattgtggacaatagatctttcaaacaaatagacccttgtctgttccttccttctgtaattgttggcagagttctttgttatgtgtctggtttcttgaaactttgaatgaataaactaggacacgggattaatgtaaagaactggcatctttgctgacttattcaacagactgtgtgtacatagaaaagagaaataagcactttcagaagtgttgtctgcacatgcctgggattttacaaaatttaaacaatgtgaaatgcagtaccttgaaaaaagccaggctagtctctggactctgtagtttactttctaaataaaaaatatcctattgaccataagcaaatgaacaattcacctgttagcatatggaccaaatataggccaagatatgtagtggtagagttacaagtaaattttttgatgtgaagtgtcatagaatttacagccaaatgaagtgagtacctctttgtagcagggtaatgatgaaaaagattaggcaaagtttaaagttgagacgcagttttcctacctggagagaatggacattgttacctaaaattcacattgtacaatggagtgatacatgagttgttcacagtagaccgacctttctcagcctcagctctgttgacattttcaaataacaacttgctgttagggactgttctgcacattgtaggatgtttagcaccattcctatcttatgcctgctagataccagcagcactccccttccaattgtgcaaataaaaaatgtctccagacattgccaaatgtcctctggaagtcaaaaaagcattcctggttgagaatcattgtactagaccaaggaatggatcatattgaccagaaggaagttgtatattattaaaaaaaattatccaactccagaagaagtatactggggcagtctaacttggggaccttttgaatgtctccaccatgggaacaaaggctaagtaaagcagtggcccattgctcagtccaacagcactcctccatcaattaccccctcttgactttttgtgtctttagtctcttaatcggcctcgacttcttttccttgacctttaaattgtctcctttatcctaaagcaaatcaaaattactcctgataatgcaaaggtataaaattactatgatgtcttcacatcactactaacttttttgaaaagtagtcttcattctctacctctacttcctcactgtctactttctggaatacatcccagtttggttttttccccctatgtcactacttaaagtggctgcccaaatgctacaatccaacttctcaatgatcacattaactgaactttttgtgtacttatctttgacttccatgcaacttttgatactcttaatcaatggttctgaaactttttttgtgcatcaggatcactggtgagttattaatagttaaaatacagatttctgaattcaacacccagagttcctaattccgtcgggctaggatgtagactgaggatttgcatttctaacgagttcccagatactgtccacgctgctagtctgggggatcacaaatcaagagccatgccttgattattctcttcttgagtgcttcagttgacttttacaataccatagtttcctgatcttgacgcttaatgacatttgtagtcacattttctggtttcttctaccctttttctctaaaacagggcaatgttgcccctcagagaacattggtcaatgtctggagatgtgtttagttatcacaaataactaggaggaggggaagaaggaagagaagagggtccactgctactgatgtctagtgggtagaggccaggggtgctgctaaacatcctacagggcacaggacagtattattcacaggacaaagtattattcgtctcaatatgtgaatactgccaagatagagaaacactgctctggatgcaggcattctctccaagtagatatatattctttttttttgttatgagacagggtctcactctgtcacctaggctagagtgcagtagcacaatcatagctcactgcagcctccaggaatcgagacctgttgatattttagtcatgtttatgtactcagcatatttttttaaaataatatgataaaataccataattaaatgattactcaaaagtggtctactatattaggttttgtgtatattacttaaaataaactatcacttctttaggcttctggttttgaaagttttgagtagttaacttagtcatgcacatactggattcctttcctattatggataacaggttgttgagaacaacctggtcaatattttggagagatgaggacttgctatgttgctcaggctggaatcaaactcctgggctcaagcgatgctcccacctcagtctcccaaagtgctgagattacaggtgtgagccatggcacccagcaaagaatggcctttttatcttctcttcagtctatacctctctcttgtcgacctcagacatgcccagcacttcaactctcacacgtctctggaaatgactcccagaggtattatctttaaatacgacattactcttgggtctggcctgaatttgcaactgcctgataaatataagcttaatgagccaccggcatcttaagtttaagatgcgcaaactaggccaggcacggtggctcacgcctgtaatcccagcactttgggaggccacagagggcgaatcacctgaggtcaggattttgagaccagcctgaccaacatggagaaaccccgtctctactaaaaatacaaaattagacagacgtggtggcacatgcctgtaatcccagctacttgggaggctgaggcaggagaatcgcttgaacctgggagacggaggctgcggtcagccgagattgcgccattgcactccagcctgggcaagaagaacgaaactctgtctcaaaaaaaaaaaaaaaagaaaaaaagcccaaactaaacatatccttccagtaagagaatcctttattgccagtaatggtaattatttgataaggtgtgtctctacccccttttgaccttcataacttgtaaaaatggtacaagatgattcttttaagaaaagtataaaatcacatgtatggttcagaaataccactctggcaggaatttgaggaggtgacagatattcaagaaaattgaaagagaaactttccattccatgtgagattatctaacttttgattggccagggagaaatgtgtcttattattccaagtgaaagtaaatgtatctgcctgcctagatctcagcctagtattgattggagaaaatactgatctgatgctttatgcttcgagaaagaaagcatattgagtatatgatcttctcacacatatgatcagtcttttcattagatttgttttaccgtgatgtattttgttcctcaatagaatgccatgtatatgattgttactggtactcatagtaaatctaataatatccaccattttcagagcacttactaagtgtcagaacaagtgctttgcatgccatcttatgtatactaagcctatggggtagattttattattgtacccattatgcacccatggaagctaaagactagagagaatgagggatacacgcaaggtcacctagatcacaactggtataattaggatttgaagacaggctgtttgacacctaagctgatacttccaaagactattccaatagcacaaaattcaattgctgtggggacatggttctcagaacctggtcttcttgaatcactagaccgatcctcctcagaatttaagacctgggtggaaagggaaagaccatccagctcaccccatgtgcctctcaggaatggtgggggttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaaagttattctcagtcttccttcttctccatgccttgtcaaagatttctgcaactttcatctcaccacatctggtgagaatacttatcagagaaagtgagcaaactggttttggtaataattgacatacctttatctactaggagattctgattttaattcattcagtaaaaaaatattctgtttgttctatgcacatttctaacacttgagacatattcaagaataagacacacatagtccttgtcctacagcttacattctggtaatatttgtcagaaagcagtcacatgattatgaaaaggttacccaaatttctgtatattctatagtttatcctatatcttcttccactatttcacacatttcataaaagatctcaacatataaatattgcttttagcctgtgatattgtctccatggagggaaggactcagatggaaataaggtatcacagaagggtgcagagtgccttttcttttaaagtaattgcaaaaataggagttatattggttatcagaacatgtttgtatttcattattaagctggtaaaaagaaccatggatatatggacatgttctggatcctagatacttaatagaaatgatcactagctgtccctaaaggatttttattatacttcctaaaagcatggactatctcttctgaggtatgccccccaaaatgtcagtagcaataaatttgtaagaacatttttaaggcagcacagacaagtgtgatcggtagaagtcatggtgagtgggagtgaggaagggctagtagcaaacaagaaaaagaaaagaaaaaaaagcattttcagtctttggcagcacttctgtctcttccagcatttgtcagaatccagttattaacctgtcagcctcagacagattgaaggagacaccacctttcaaggtgagcccttaagaaaagaaaaataagaaacagtcattgttggggttgacagagacatgatcccaccaaggcctgggctatgcttggagaggaaatgatactcaagcctgagtgtgtgcttaggggtcaagagattaggcttaggggagtagggatatggaagtagtgatagcagtgaataaggaaagctatctgtttgaatttgcttgtgcaaagaggcagaaccatttcaaagatacagggtgcagattttagtgaagatgttagagctgacccctgctgggactgtggcatttcagtagaggaatggtgaatcccttcccagtggggaacacacatcatccacatacatgagggaaaaaaaaaaaaaaaaggaatgactctttttatcaacaaaagcatgcccttatctatgattgtggtgtcattttcttttaacaaacaaggatagtttttaaccttagtttgctcacaaaagcttcagcaaaaaacaagggacatcaaatatttctggatttccatgttctgggcacatagtagggctgtgccttctgaaacttcctgtatagaatggagccacatgatcatttgcaatcaatgagctgtgaaggggaatggcatgtgttccttacaggccaagcatttaagtgttgatgtgagagtcctcagagcacttttttttcttttgcctttgtcatggtgccatggctaccagcaactttcagacagtggccattgcatcaacctcaaccctgaagtgaggaaccgtggcaacatgcaggcaagcctcaagcccgcccacagtagacaaacatatacctttattgttataaaccattttggacttgtttgttactgcagcataatctggctcttatagtggacacatttggttagatacaagtgtaagaagttttattttccttgatgaatagtgggaaagtgtgtatataatattgtaaaccttttttagcacccaaattaacacccctatgtacccaaagtcctatatctgggctgcagtatccccaaagacattttgtttgttttattttagtcctgtaagaattaaagtcaactttttaaaaaaatgcagtgctaagagagacacgacaaaattgagacaatttattagcggattctttcttttctgaggggtctttttgcatgtaggagcagtcattaccatctgtaaggtgtctaaagctcaatttatttaaatcatatatctgaagaccaaaacttttaaaacccaaattttgtttttaaaactttataaaagatggtaaattcctcttcaaaatttaaacttcaactccaaatttagtatgggtgatttctcataacatttcaaataccttttaaaatacataccttttatacttaaacttaaatctatagtaaattatgagtttggttcattttatcattatatctctatgtgtttttgtattttctgaggattatattagattaataccaatgaatctattaaatagttgttgcttctctaatatgaatcaaatctaagctgctgatcaggctgaggtgttgtttttaaatcattaaatttatttattgtgtcaagacataattgcctttcccaaaaagtctaaatgttttcctataatttgctgtctctccacaagtaatacatttttaaaagccatacttggtgagattatatgatccttgttcattattaaatattgccttttatttaacactattaaaaagatatattcttataaacagcttatttaaagtcaggaaccatctggaagtttcatctcccaaaagatgagatgaatccaaatagttctttctctttctagcatgtcaaactaatgtgtcatcctagaatgcatctctgagccccatttcactaggttattaggtgtgaagcccagatctagaccaagcctgtctgctcttggtaagcctctttctttttttcattttttctaatactgtttgatgtatttcctgttatttttatttactgttttctacttatccaatagtaacatggccatgcctatactttattactttgtaaacaagtacctaagtaacagctaaactaaaacatacatgttcatatattttagcattcccctaatcattgaaatcaataacaattcaatatactctattgtattcatatttattttatattaccactatgttttatgtaataatattctgtatattaacttttctgagcatcactatgactttttcacaaacttagcttgttttaatcaacagtaaaaatgaagagtgatgttgttgttagcaatcttatttagtgttcaaattattatcaaatggccagcgagatctcttttaaatgggctccttattctttcagcactttatttgatatttgtggccacatacttgtattttgcaataaaaaaaaatttagattctttgcaattattttcttccgctaagcagaaaatcaacaaaattccagagaaccttgtgcaaatgagtgttgattgtggccatggtgcacctgcactttaagtaataacaaagctgaaaaatatatttcttttagaggtcatgagttcacactgagaagtgtgaactcctcatgagttccatgagaagggcataactttaggtaatttcttgtaagctcattgccactatgtaaaccagcttatgattcttatctagttggtcagtatactataaatatcagtgaatattcagaatagaagctgatagaaaaatcaaaccatagaaaagcagggagagtgtgagaatatattcaccatgtgtacatatatgcccctaaacaaaagcctgaaagtatctactctaaaattgatttatcctcctcactatcctttttaaattttttatattattcaccttttcttctttgaacatattttatttttgtaatgagaatgcaaagatgttaaattttttaaataactaaagaaaccgttccagcaggaaatagcactatgtgttgttcaacatacatagtgaatcttgcatacacagcatattaataaaatctcaaaaattgcttactctttacaagtaggagatattttgctttttgtgtccatactttccctttagaatgaggaggattctaagtaatcttattgtatcacatttctacttcattgcattgctctctaggggggaaattaacagcagaagacttgtcacttgagttctattcatgaccactctactctgagcattacagatggaatgcagcaaagaggagatacaattctaggggaatatgggcccatagatctttcaaaacaaagaagaaaagctttctcacaattgctatagcaaataatgctttccactgctttagagtcatcactgtaagaacatttgatccacaagtgaagaacaggactatattccatgtggcttttcaaggcgactgagagcacctgctccctagaatccttcagccacattgatatgtgtgtcataaaactgtgagatcatgatcccattgatgtgatatgaatcaagaaagccatatgctctttgctggtataaatgatagctgcatgagggcttaccaataagtgaggaatgaaatttgaattttggaaagaagtttgtagctacatgaataccttgcagcctctcttttcaatagtctcaacatttttactgccatgcgatttcttctatagctccatttatatccaacttaaatttcactctaaacattttcattttttattttttattagacaattctcttttgattatctcgttttataaaatggcacatgggtttatcacttggagacaaagaagcaataccctatatgctgtgtgtgaactgagcaatacgttcagtgaccattaactgacagacttcacaagaactcatgagattggtcaatgatcacgaagtgcatctgtaattcatgtagctaatgtggactgaagaactaagagcaaaacatacacttcgtgcaaatacccacagttaatatagcatagaaacagaaatttaagctctgttgttagaaggctggagttatgaaccaaaccatagtaactaaaattcatgcatattacaaccaagcaaaatgcagactacctgtgtgtatatgtacatttagtatttttttgtttgtttgtttttaactttgtagcttcagcacaccatgccacaaactttgtgccttataataccttggctgaatatcttctcagaggatgatcattcacttttacctttgtttgccaacttattccactgcggctctttttgtcttgcaatgcattctgtgtactggtgaagaagttttgaccacgaatagctgacaaatatgtgcaggtggtcatgcacagaagcagaaagaaaattcctctgtggttgttaacgtgaaggttttccaggggcttggggcactggttaaggaaacagattaatgagcagcaaacaggaattgatgggagtcctctgacattttgaggatatccctacacatcactgcaggctgagggaagcttggctgaaagaaactggccagaggcatgttctgactttggctgacttggaaagaatggcagtgctattaacaatgtacacatagtgggagaatttcctctcagtggaatgatgctttaatggtcccatataatgctaatgccattagcactctcatttccagatactacatgggatacataagtagaagagttaggaatcgttttctgaaaagacattctaatattatttggatattaaataaaaataaatacctctgttaagatattcagacccagtattagtgtaagtgggtacagtagaaagaggccttaacttggaatatgtagtgattaggtttaactcacagccctgccaattattagctgtgtttgcccattcatttattcatacatttgtatacattcttttattttcttacaaatctttaccaagtgcctattacgtgccagatcccacaccaggctttacgcagtcagggtcaaatcacttcacctcttcaagtttctcacctgtaaaattctgagacttttttgaaatctattttttaaaaaatacatacttgattcaaacagcagctttataatttgaaaacctctattttactcctgtttttctttggaggccaaaggtgactctaaataatttcatgaaagtaatgaaaatataatctttagtgattaacttcagaattaagagagtaaaaagtatttttcaattcatcttcagcttatgccatcacctcagcaagaacaatgagtgtgcaacaattcactgttttgtaggatgctaattagagggtagactcctcatggaaaaagcccaagcctctggttgactcctgtccatccagatggagctacaatgaaatgattttctatggctgtgtgtgcgtgtgtgtgtgcgcgcgtgtgtgcgtgcgcgcacacacacacacaagcctgggaaggaagagccccccactctgtccattattcaactcaatgtttactgtcaagatgagttttccaatttccattgtttcccctaaattgagtctctcacatagagtttagagctggtatgtctgctaggaaatagctatataataaaacatccatataatagcactataattcatccagttattcattccttccctgaaaaataggacctaaaatgcatcattgtgtgtaggtttcaattaaattcagaggacagttattgactgactactgcatgcaagctggctggactgagagtattgagatggataagaaactgtcccctctcaaggagcttaaaatctagaggaaagagaggtgtataaaatatataattgaaaatgtttgctgtaatttctaagagaacacacctggggatgtgaaaatggacagaagggaggatttagctctatcttggaggctgggatataagtcagggaaagcatttcagtggagattacgcttaaagtgggagtactgtatacatgaataagcagagcaggccaggtaagcaaagttgtggttggggaaagatgcattccagacagccagaatgttttgcctcattggaagattgtttttctcacccttagcaccctctgcttattcgtctctttgtttttaaccatttctaagttgtatcttaagactctaatcaatgtaatgggatggctgtatccctccccactccatcccatatcacaccaccgaatgagcaacaaatcttggcgtctgaaaaatgtagcacctgacgccaatcaaaacttctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaaatttccaaggagaaatataagtaatacctggaacatgactctagaggtaggctaagactgcagggtattaatcaatgtataagtttataagtttataagcatgtgaaaacttcaaatttcagcaatgattctctaaattttttgctgagacagataaaatagctgtttttttttctcacacagagtacattctcataggaatatctgaattacatgcagttcctagaaagcaagctataattacattattcaagaaaacactgcagttcaggctaatgtttttgtatatttgttttgtacattttgtacatgtttttgtaatgtgtttatacatatgtacatagaaggctttacatttggtgatcagcatttaaattatttacgtacttaaactattacaaatacactacttggcacactctttccccagatcttcatctggctgtcccttttcatcttctagatctcgactcaacatctccttcttaggccatttctgaccactataactgatccctgtcacgttctatcataatgtccttttgccattttcttagcacttattagtgtataaaattatcttctgtatttagctgtgagctttcctcactagaatgaaagaaattatggacaatagttccacctaccttgttcagtagtacacctccagcactttgaaacctgtggggaaacaacaggtactcaacagatagttgttcattggatggactgatgggaaataggccatcttgtctttattgaacaacaacttttgcaggaagcattctcctcccttcatgatttttgtgcataggtaagcacctgcttagacaactccagttcctgctctcacacttcaccactggattgttgcaatgcagtcttaaatagccctcgaatatggactcaaccacatcttgcaacaagattgtcatcagcacccctttcactatgcttggcctctatatactttactcttagccttctcctgaattagtcttagcccagtaacatcttgtgctgatgtcagtcttctggttgaccaagtaaacgtattttttcatttcctctttttttgctcgtctttttcatctctcgctgatgattgtcaactgcaatgacaccgtacttttatacactgcatgatgtatacttactcagaatttttcttattgccaaataaattatttcatacgcttatgcaactcctttcgttaaaagcatgttttctactttgttctcattattaacagaactattttttcagttatcttactcattgcttttgcactgattggacatcacagcattcaaaatgttcacaaagtacctaaaaaattgaacacagaggcctctgtggttagggtgactgaaaaacttaactggatttttaagtcagtctaattttaattaacttaaactttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctccaacttaaacttaactttaaaaattgatattcaattcagtcactggaagacataagtatgtgtgaaactactcggatatatgaattactttttcagttgtaagttttgtgaaatgtatatacagataaaatatttctagtaaaaacagtgtcagaattgagatgtgctgtaagtataaaatacacatcaaattttgaagacttcatatgggaaataggatgtaaaatagcacatttacaattttaaattttgatcacattttgaagtaatattttgaatatattgggttaagttaaatatattattaaagttaattatacctatttctccttttttggggtggctgctagaaaatttaaaattatatatttgctttgcattatattcctcttggactgtgttggcctagatcgtttattagcttaggcaacataatgcaaatttacattaactttatttggtcttcatcatattaataataaaagcaaaacaaaacaagaaaccaccaggtgctaatagtcacaggctgagttccctaggaacagactctgagattgagtttagcatgccacataatttttaaggagttccctggggaaggaagtaggattgagcagagagaagttgagctgcgatgcaggcccaacaatgggctcagctaaccccacgaggagctctgacactaacatgacctttcagtttgtcctgagttgggccaagatggcaaagtctttctaccccatcatcaacaggtcattgaatgcgggtcactctgggaagagcatgatcttaggcaagatggtgctctgtgtctgaggccaaccctgaaggcgctggcagctgaaggctgtctatggacagcactctttgcagctcaggtcaggcagtaagtctttagttgcagggtgagctgggcagcacattacagtgtctactatactaacattttttgttgaagatttcccatgaagatattgattattgtctttttcagtttttaatcagatgcattggctaatacctgtttgtagctgaagctaagtctgtcctcttaggccatggtgtgaattgtgtgtttccctttcttccttcatctctggcttagctcctttcattaccttcatggcccctctagaagtttatgttaggtttttaaggccagaccagactgacttgagcccagccgtaattggagaccagattcaaggctctctcttggtggcaggtgacattagtcagactttattcttatctatgaaagttcataagtaagtgagcttttgtgtttttctgcttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaaaagaaaaaaaaaaaaaaggaaagaaaaaagaaactgaacaaatacgttatttactgaaggagtaaatatgtgtgacaaccagtggtgtcctcattccgtatctccatcttcagagaatgcttgtgtgccttcaaatttatgacattttcctctcaccccttagtggtgaagaaactgaaatattgaccccatccccaaaaattaataagttaagtgtaagtggtacctgtggtccatttgaaagggaatatctgaatggaatgggaggacagccacctattctcagcaggcagaaagggtacttgtcaacaggtaatatgggaaagctaagaaagattaagactttatttttccctatagtctgcctttctgtgttcccaattctttacactgctgtgtaatgttatggaatatgattctcaattaggaaacttgaacgaagacaaaaaaaatggtaagagactatcttctaaatatatccttagttcttcaggcagcaatttaatttcagttaaaagaaagaacaaaggcatgtcaatgttttggactgaggctaaccgaggactttcactggcactctttttagagctagaccattggggaagttgcagtgttacataatgctatgcttctcattgccatagagaagcagcagctgctttgagactttagaaaatcagcagcgacttgaactctgtgttgcttgtgtccagaaaattccaggcactttgtcaatttttttcttcattttcaaattatccttttgaggaaaatataaaggagtaatcccattatctctattttagagataattcagctgagtttcaagaggtttgttgtcttgcttcaagttgtccattagcagaacgaagaacaaaatcttgctttctgtctttcccagactgattctctattgtagcttctctttggctgttgatataatatcaaatattttgtatgtatgtgaaaaatttgaaatttcatttatttcactagtttaccaaatccctgcctttcactgctgaccaaggttagaactaatataaaactatttcctttagaatgcttagtgaatattttttgccactaaggctaaaacaccactgataatttttactctctcttgtatatgtttaaataacagaatagaaaggaatatgggaggtacatgatatggaatgagacacatcttgactaaaatattttagtttagagcaaattttctctgatcatagttattcaaaggatctgtttatttgtatgtggcatgatggtgtgtgtaacctcacaaacaaatgcagagcctgggaataagaaagatgacttatggtttcacctccaagattttgactctgaaaaagtcatagaacctctccctttcatagtttctctccctctctctttcatataaatatatatatttcacaataattacttgaataaatcctaggtacctctcctaaagagttttgaaaaataaacacatagatatgaagaaagatggcccaatataaaccaacagtggtcctactatccctgtcctctatgggcttgctaagcaataccccaaggtaactttcaagctgactttgatgtgaatgcccaggttcacgtataggagtaacatagaccactaagaggggtttcttgacaatccacagtatctctctcccccttacaaaagatagtttttaacatcaagaggacagttgttgactctcatttgaattattaaaccaaataagtggctgttaaaggagcaaagatctgaataataatcagttatcatttgcagagataattcaaatgatagctaattattgggcaggcactctacataaattatttcttttcattcctatgagatgggtactttatgaggaaagagagaggttcagagaaggcatgtcagttttctaagatcacacagctcattgttgactgagccttgacatgaaactacagctatgtttaaaaccagtgctatttctagtgtactatcctgcttccttgtaattatccaacacttttcttctttttctcctttttaaaaatcaggtagtatctgattgactttgtctttcttttttgccaagggtacactcaccaactgctgtccagagttaaatttatagtcacaaagcaagagaaaagtctttgtttccaagccaatgggctgggtttccagaggcataaatcctaggaattagtaatatcccatataaaatcactgaaggttggtgcctatggttatgtcagtggcctctatgatactccctaaaggcgtaatttattccacagtccctagacacattcgttcatgttctttgaaacagggcacacttgcctttcccagaaatttttcaaccaaacaggactaggacatagatcaaggtctgtcagcctatgctcaaagtgtcctctgcagactttgttgccactaaactagaaataatccatagtttctcctgtttccttttccgttaatgaccaactttatatacactcaaaatgaataagtgatacggtttgttcttctcctctacttctctgtttcccaaagtaatttgcaagttagaagaggaaatccattaggagaagctgaatggattaaaagataataggatttggagaacaggacccagtgaatcacaaattcattacattcacagctgacaattgctaagtcccggcctgctcctctcacaatggggccaaggtctgtgcagcatgctggtgtgcctggtgaaaggagaaaatgagcttcataaatacaaacgttagagtcaatcttatgttccccagggactgccagtactttacttggcaagaatagaaaaggaattcttaaggatataaaggcaaaaacgaacactgtaaaacacaaaccacaacaatggaaaactatagagccttgcttccaaagcttagtcatccatacttttctgaaatgccaggaattgggatatggaaaagagctcagaaaactacaggaggcatccatggaacaaccacagaattctcattctggaaagctttggcagggctatgttctcatcatttcactttaatcaccttttaccccttggggccatttgaggaccatgaaattctaagaatgggtagaaaatactcccccaaccaaataagaaataagattcttttgtttctatatgtcctggattctgcatgctgcctgctcggagaggagagccttacactggagtttgcaggcatttgctgctgtctcaataggtagatcttcagttaggtcccagcttcatgccatctgttatttctaaagtattttggccttcagctggaggaaggtgacaggagagtgttctgttcctgcagaaaatttgcttgtcatcagagtaactgtgtactgttgaaacagctactgcctacatttcactgcctcttgaaagctagcattttggtgtgaatcaattatgaaaagtgatgcacactgccccaacacgcacacatacacatacaccccgcctaaaaacctgagacataaacaatgtctagaattgtgggcaatcatgcagagcccttcaaacaatattaaaatccagccacttgtaaagagtgagtaataaaataagtttagggttatataaattgagtctaataaaataattcagattcctatggtacattacagttttatagtagtgcctttattttctcttgttcttctacaaatgcctttttgaatatttattcattacccatttcctggataaagatagtaaggcttagaccttttaccaggatatcatagcttaaaaaatgacagagctatttaattcatatttaaaatcatattttttcttttgcatttttctacttcctggcatatgtttttttctctgatattagggtataggacaggacgaggaataattaaagtccctccaaagattaggtcagaaagggaccataaaagcttttccattaggaagctggctttggcgtttcattgtcattggagaaggcccatctgtacctatggcacgtgttatgctaggaaaatacctcctgaatccttttgtagaaagcaataagatagcatttctcagaaagaaaatgctttgctaagcaaatactttgaaaaaaacaataaatgattttttaaatggcattacaatgttctttgaataggacatgggaacaggaatcaaacttggatatattgtattttcatcttattttatttcatttttattagtgacagggttttgctctgtcacccaggctgaagtatagtagcatgataatagctcactgcagccttgaccttccaggctcatgatccttacgcctcatcctcctgagtagctgggaccacaggcatgtgccaccatgcctggctaatgccttttaagtttggtatggacaaggtctcactgtattgcccagactgctttctaactcttgggcacaagtgatccctccaccttggcttcccaaagtgctaggatgagaggtgttattgcatatttttacaagtatcagacatgtatgttctgaaaggcactagaatcattgaaaataagtcactgtgaagtgcaatgactcttgaagataggggatagcagaagtgtgaaactttgtaggctaatcattatggccaatgcctaattaggatttatagtaccaaggcctgaccaaagtcataaattatcagacaaaattattggacagaaagtgaatgactgcatatcttgttaaaatcactagggaacttaggcagaaggtaatgactgaaatgagaacttgcctgaaacatcaggctaaaaatagttcttgatatatgaagatgatctgaaaaatgagccaaaatttgtgttgcaaaacagcaattcaagaattcaatcttaaaacattgcctatttttttcttcagaaaacaggatacaaaagtcagtgtgaatgagcaaagccattgagttgctcccaaagcagaagaaattagacaaagctattatggaggagatggggatggatttccacaagagagggcaacctctatgtgaggggtaatttaatgaaaaatttgcaggtgatgcacctgtcttttcaaagttcttttcatccctgcaatttcatactttttcaccttcaaggccaatggctttgtcagtgctgcctgaattgtgcctttgaatgagtaatgacagatttgaaataagaacattggagcattttaagtgtccagtaatatttgctcctggatctactttgaatggtgggtgtgtgatgactggtctccatgaatgggatcatctaatgccttttaaaaattaaagacatagtgtcatttggactttttatgatgcagtactatcttgtcacagaagacttcaggatttctcttggttagcaagtcaacagagacctgtgtatctaggcctgcatatatgcatgcatgttgttacttgatatattcggttataagaaaaggaagtcagtcctagtaaataacaccatccatatgagatttatgggtttcacttataaatattaaattaataaataaaatattatcctatcatacttagtaacaaaggtataaggctacaatattacacctgtcctgtaacttcacagatatctaatgaatatctagaaaacatctctgacttgctgcgagtgtgtcactaaagccctacattgaccatatatgtctttattctctatctgataatgttgcaactttcacattatttttgaaagttcttaattggtgattaaattcctgagaatttccagtaatgcataccaaatgtcctgagactttttagacataaatctgactcaccttcaaaatcaaaacaaaaaatcagtattactatgatttcaagtcataatctgaatttaactccacctttaaaattaaatgctgccaggatcacatgctcaaaggctttcttggaaatatggcttatacaaatggcatatgcatatatatatatatatatcatatacatggcatatatacatatatatgagatatatatgtatataatgtatatgtatatataaaactggcaacagaaacacaggaaatgatatgaaaaaattattttgttcatttggaacgctgtatttgttgtcatttttgaagacaataaaattgtcattcgaaccaaacccatttgtttcattatctattaatttctatctcttcacactgcttggattggagatagcaaacaggccatgaaaacaccttgggaaaataattcttgcacattctctaacaaaactggaaaaattactgatagattcttggtttggtcatatggtgcttacatgaactggagaactttgatttgagctagttcaaattttaacacactatccttacatacctacgtttgagagactgttatatgggatttgagagattttgaaaacatggcctttttcttgccgtttgtgagcaaggagagatgtaagctgtttacctctgtacccagcaaaataccttccaatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaacaaaaccttgtccttattactaccacttttagaatgccttaacttgcccttaatgcctagcctttcaacaggtggattcttgtgtgtcctgaataaacatacaaacacatagaaacacacatacacaatacaaatgtatatatattttgtatagtatatctgtatatatttaggtacatattttaaaaacaaacacattcaagtaagagaaacattgagtggtaaaagaaaaattagcaaactgatataaggtgtagcagtcttacttatcaaatggaacaggtgtctttttcaaatttagttggtgcctttaattggccatttattcctgagtgtgttgggcgtagtaataaatgatatgacaacacagctcatgccagtggtggacttctacaaccagtggaatagtcaagaaaggtcaagctgtctccattgatttgaaagtagattgtacctacttatcacaagcaccttagttttcctttccttcttttctatgaaggattgtccccttgtccatatcacatgttatctatcatccttaatgtcactaataaattagattattcatggaatgtgcttagccctgtgtctggctccttgtaagcagttgataaatgtaagctgctatagttatcacactttgatccttaccacgtttccttgatatattgagggcaaataattgaatctgcattttattaaaagaacactgagactaatggaggtgaagaggttacctgacttctctttggctcaggatcagtgaacaatattataggtacttgaactaagaactccagtcttttaggccagtgattgctcctcagtatcaacatttaaaagtagttagttattcttgttttctgaaaccatcctgagaaaataaaggagataccacttctgtcttgtctcttctccctggttttaaacctgtgccttgtcataatgcaaaggccatgtatttatttaaaaattataaacacattttacctgaagtgacagctgaactgtggttctaaatagcctctgttggtggcctcaaacttctgtatatattcggtatattccattaagtgcaattttatgaaaatgtcataaacaaatcaatcactcttgacttaattttcagccaccatcagcttctattgagaatctcagccatcaaaatatccataagaccatatgatgaagtacatataaagtactgtgtgagcacaatgaaaaagcaatgagattcttttggggggttcacggaaagcccccaagtgagggtgccatttgaattgagtataaaatgatgaatagagatttgtccattgaaaagggcagacaggccaggcacggtggctcacgcttgtaattccaacactttaggaagccgaggtggacgggtcacaaagtcgggatacaagaccagcctggccaacatggtgaaacctcatctctactaaaaatacaaaaagtagccaggtgtggtggcgggcacctgtattcccagctagtccggaggctgaggcaggagaattgcttgaacccgggaggcagacgttgcagtgagccgagatggcgccactgcaccccagcctgggagacatagtgagactccgtttcaaaaaaaaaaaagtaaagggcagacagaagctggagatagagtgacccctgtcagactgagggggacatttgagcaaagatatgaatattaaaaaaacaatgatccaatatggttgaattgggtgagtggcaagagtggctgttggcaacctgtgaagtggcatgcatgccaggttaagaagttggagataatttggtagcatttgagctgcaatagatcgtgtcagagagaactatgccatgaccagatgtatgacttagataaccctgacagccatggggtggacaaatggctagggttgagactgcagccaaactcttcacaatttcaggagagaaatgatgaggaatgagattgaagaagtggccatggaggtggggaaaagagagcaaattccagaaaaatattgtggatttgctcagtggaacttggcactggatgaaatatacagaataagtgcaagggaggaggcagaagattaacttggatagatgggttgataactgtagccataactaagggaaatatattaagctcctcttctcaataaagattagatttaattacgaaaatatcatctatttatttgccatcttgttttacaataatatatcttgtatcttcatataaaagcagttacggcagccctctgcactgtattttcatagggttctgtttttatcttacttaactgtaaggtccttgagggcaaaaacagtcaagcctttctcattcatcctttgcaaacccagcaccctgattcccaacagggtagaactcagcacatatttgatgaattagattgaatttaaatctatatatagttataggaataaatgcttggaggattttcctatctctgtttcaattctttgttttagctcagtctttttatgttggctcctgtaagctttttgcagtgctgcaaacacttctagctgacaagagagaaaaagaaagtcagtgaaaaggaggagggggcattgcagcatctagattgaactctccaggcttgcctgtctcataattttcacctttggtggggaactgtcccagatttcatccaccaggctaaggttctgacatggtaccttcttaaatcaagcttgaagggaaattgattgaaaagaaaacaccattatgggaaaacaattcattttcttccccatgacagaaggtagacttttgtctatactgcagaataaatatgatctggctgattgctttaagatctggaagctcagaggagtcataatggctttgctcactctttagagggaaattaccttccattttggagacatttgatacaaaggttttggttagctttcaaaaagtaatattttttctccctgtgtgattatttatattagctagatataggtgcatgaaaacttgcaaatatttctgtgtgcagttgtgtgtttctactgaagtaccctccagacagggagtaagcagattttttttaaaacttttctataagccccttaaatattacagtcgtcccatgctttctgtgttgaaagaaaacaaatttaaactcataaaggtggagtgaaggcaaaaagatagaataatgtttacctgatgtttatagtagtagaaaacacttcattgttagaaatagccaagaaggcacttacgttgtgggacactcatccgtcccgttgacaaaagttggattcattttatcttgcagaaattgcaaactagcatcccctcagacaaaatctagccctgataatacgtatttggacaacatagaaattatgttggcaagtcttttctacttcaacacagtccccaccatgcccattgtacaatggctggccaaattcacacatttaagttcctagctcccaaaagacttgaggttgaatgccttgctaaaggtttttagtgcaactctgctttgctagaagatgaattcctaccttgcaaaaaactcggatgcatgtctcctgagattggaatggacaaggaacaaatgtacttgtttgtagtacttctagaatgtctccctaaatcatcttagaagcagaaatcttacccaaaatatgatgcttgccaatatattgtttaccacccatcatgctctgaaccatcatgcctcttgtctgggtagccttgctctatgaggcaatttgtggtataaagatttttcattaagttttggccagtgaagatgttgtcaatgtacaaagtcagtaatgcttcttgtgaaatggtcgcctctcatgccaatcttggaagcgtaacattttcttgaccactttagttctaatgacttcacgtttatcctgaactagaaatatggtatcttcttggttgtttattctctttcttcttccctctttatatctctccatccttctttcttccttcttttttcttccctctatttcttccttctttccatcattctctcctctttctttctctcattctgtttcttcctcttttttttgaaaatcttagcaagagttaatggacttatgatctaaaaattaggttattagaaatttttgtcataaaacctggagaattgatgtttgaattctccttggctagagtcaatcctttatcctttttaggtaaatgaattaagtctcatgcaatttcctgtgtgggagactctttagatgaatcatttaaatggaaagccctgtctgctcatcaaggggcgcgattttagagttttcctgagtattatgtgcacgcttagtacagtcattgagatacataaggcaaccatgtgccttaatctgtatgaagtctcagttcatatgtgattatttaggtaaagtatataactgaaattttacatcttttgatctctttgcaaaatttccctgagccacttaaaaataacctttctttactcctttttgtcttgaaacatttttattggaagacttcagacctaactttagtaccagagaccgaaagtcatatctcacttagttctacaatctctagtccacttttgatactcagaatagatagtaaaggtgctatttttttaccccagagtgacagactgttataaatgttgggatcctatgaagtactgtggagagtatttaatgagccgttgtagagcctacacagatacatttatataagatattgtttttataccagcctcaaatgctcctaggagcagccagacaggtcttcctcaaaaggataatctggaatctttacctttgcaattgttctatgatacttctctttcaatgcacaactcccaattaattccttggtactccttgcaataagagaaaattaaaagggactcatttgatattagatgggatcacacttatatacctattgcattgtataataagtaagcatgagtatcattctgttgtatagtcccaaacttttccttgaaataattggcaagaggatagaggaaagacatccaagatttattaataccttcatggttctagttacctctataaactagtgaaaccttttccaaatattgtagataaagaaattgaggcacagaggtgttacttaactgattcaagttcacacagctaataaacaacagaggcacaattccaaaccagctcttcatggctctaaaatctgtgttttttccataataagctgcctaatttattgcgcttttattgtggtaattattttacaagcattattgcatttaatcctcatagccttgttatgtaagtcccaatagtccccatttttgctgatgaaggaagtaggattcagagaaatcaagtagctctcatgttgtctcacagtgaataagcaatagattcaagatgaactccagagcctgtgctcttaaccactacagaaaattatgaaattacaaggcatggtcctgccttgtggctctagcatcaagttggtaagacaacacaacaccaaggctcttaaggaatcctctggacttgagtgtatgtatgggaggagaagagggtgttctaggtaggatagtaacatgacaaattcaaggatatgagaatggaatgttcagctttattttcattttagataaagttataatatctgataagatagcatggaaggaaggaacttcactctcctggagtgtagagttgtcaggagtggacttgaaaaaaagagtgacaaccatgaggtctgataggctttagaacgcaggtcttaaagagcctggagaaaagagcgtgcatcacaaatcctacatagacagcaaaaccactgcccaggtaaaccaaggccgcagtctaatcttggaaggagagagtaatttaggacagcaaagcagaatccatctccttgggcaaagcttcaggaaagccctgtctgaatctaagagggagctctcggaaggaaaggagaaggacatttgcagaaggaagagaggcagccttggcccttatgaactctgggggaggttcctccccctactcttaactgaatgtggccataagttgaacaccagtgaacaccagcaactgctgagactgaggagagcagcaacaactgagcaattaacctttggtgatgggcttgaagttctaattaagagcagagtctcttctatcaggtgggagggggaacagcagaaagatgtatgagggggatgaaaaagaccagcatgttagcaggtcagatttaaaagacatccaaatgggtgtaagagggtgagagaaaagaaggagatcactgaccaattaatttttctgtttcccagtcaaagtttcttctcctttctcttaaccctgcagtgactgctgtgtgcagaagccagcagctccggggagagctgacgttgaatgcttatgctcctctctgttgtaaattcctttcttcatttgctgagtatcattggtaatttctatgtaaattttctcagagtagcaatttagcagcttttctgttgacaaatgaggaataacttaatagtcaagtgactgcatgtcatgtttcgcaaggaggtggaagtagcgccttgtagatcgcagggatggatgctggaagtgggcgatcttgggaaagcctcattgcctcagtgccctatttaatttcgcccatttaagataggagagaataagcttctatacttgaggaacctagtttcttgtgaagagtgattgttaggaatcttttctcttttagcacttagttaacgaatacctttcaaaccaaatcaagaggcaagaccccctccaactttgtccagaagccttcacaagcagaggcatattttgttttgtatcaaatgcttctcattgtccatattcaggaggcaggcaacagtggggtcctttttgaagtgaccagggatggatgcaggcagcaaggcatcgttgctttccagatgccacctttactataagaatcgaagtcctttaaagtggactctgagaaacttcacctaaatcatttcccaaggtgacagctctctatgcagttttttctcctaactagaaagcttcctcttgccactgcgctgaaaatgggaaaagtaggtggatggggaggtcttttttaaagcccagatttctggaatttgtggtccttctactttcctgtctccagcagtgaccttctcctcatttattcatgacagaatcatacgtataaaaattcatgtattctggtcaccgttctaaattctggatggtgaaaaaaaatatgcagggcccctccttttatggaactttcattttaggaaggaggaaacagtaagcaagtgaacagataagttagtggtataaaattgtttaagagtgactggatgggaggagggtttactggaagctcagagggttcatggtagcccactctgcagagatgagagttaaacagtgttgtgaatgattgaaaagagccaaccattcacagatctagggaggcatgctcccagaagctgagacagctagagcaaaggcctgaggtgggaaagaacttagcttgctgataaatcagatacagagccaagctgctgttgtattgtaagattatttcagactcgggagtagggatgtgtttgcacttctagctctataggccctcatgagcctgttggacacattgttaaattgatgccaagtagctcaaagcagaacccagtcccttgtccctcatcttctttctgctgacttcataagaacatggttcactttcactgccttcctttgtggacatactcagcctgcgaattaaaaacagaactgattttctcatctcccttggatcctggggaaattaaggcctgcctaggcctcagttctttccctagattgagattaaaatagctttccttgcaatcatccagatgccaatttaataaacattctctggccccttccacatataacccctggactgccttactaatttcttagcattcttctccttttctccacaaatcctccctttaaagagtgtttttttcccatgcctttcttattcttttttgtggaaagcccaaattagtttgtttatttttgcccttaaagtccaccatatccaaatgagaagtacagaagctattaccttaaaagtaagcagtgagaatcctaacatctttttttccatccccacattctcctcaatatgttccctgtcctttgatgcataagagggtgaaaacctcacatgagtattttatgcactaccattttacaagtgtttcagtaaatattacttcatgtaattctcataaaaatcttgggagatcagcaacacaagaactggtaggaaactctgtaagggggaatgtggggatgcgagggaagccagatcatttccaaagtccaaaggtcagatcttcacgttgaaacccagtctgcactgacctttgacctggcatcaccattccatagctatttgttggtgtcagcatcctggatagggggatttttttttttttcaaattgtaattcaaaggctaacagaaaagagaaggtaggcttgagaaagcactagttttcttgggactctgacttattatttggaagaaaattgattgaaagcataggtgattatttgttccttgtatctttcagaaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttgtaagtgggagctgaacaatgagaacacatgggcacagggaggggaataacaaacagtggggccagtcatggggaggggaggaggagagcatcaggaaaaatagctaatgcatgctgggcttaatacctaggtgatgggttgataggtgcagcaaaccaccatggcacacgttcacctgtgtaacaaacctgcacatcctgcacatgtaccgtggaacttaaaataaaatgacacattactttccccactgtttttttttaagcaaaagtgttctcacacagaacacaggcaagcatgtctaacatgttccattctaagtcttgcccttgcatgtggttgaaaatgactatggactatccacatcacaaattatgggttccagtgtgtatatggacacttctgaattcactcaaaatttttcttactgatccctattgccagatgggggagatcagcttctatattaagcaaggatgtgtccaacttttgaaatggaatgaatagttaaaattgtgcatttctcactctggtggttgcctatagctgtctccgcccccacccccacctctcttccccaccaccttcaccagcagtagaaaagtatgtcatatgtgtgtggggtgggtacagatagagaaacttggcagaaatagggtgagagatgtgactaacaccctcagctaatttctgtgcatgttcccaaacagagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaagaaaaagaaattacagcttcattaagtaacaccagaataaactccaagaaggcaaaccaaatcagttatacaatttaaaactttactcaaaaatcaaaatgatttgaaaccaatggtcacttaaatgaaggcagaagctgcatggcagccattattggagccagcaattcagcagaagtccaaaggtccagtgcagcagtacatgtgacaggtgatgttgcctgcatacacaaaattaaatggaactagttttcgagggtcttcttgtctccatgaaaagagaatgtatccttctgaaagtccttttgtttaaaaatatgatcaggctctgaaagaattttaggtcttgatactaactaacagaagacatgcatttattaaaaattgtatcacaaaggggtgaactggggcctgattgattgatgttgaaatttgatttatccccagtagaaagtgccaggatattaagcctctattactccacaagggataccattttgcctttggtgggtgaggtaaatcttcagattagaaatggtaaagcctcaagacttccaaaaacatacaggctcctattgtatacttgctgaagttcctataattatttacaattccctgcaaagaacattcttgggggtgagtcccagaacagaggtgagcctccagctgcaaaaaccatagcaagtatggcagggagcatctttgattcagaacagaacgccactcatcgttccatcagaacaggggcaggaggttcctgccaatactgattgatgccacgaatcaactggagttgttccatgatccacatggtccttggacttggtgctgtcctggaaactggattcattgctcaaggagctgagataaaagaaagcagcctaaccaatggccagctcaaattaggagctcaaatgaacagggcctcaaggaagtcagcctctgagaatctgagatttccagactctgataatgggaatctcacctatttgtccacttttggggtagatctagacaccgtgatgtgtcagcagcctcttagttgctgagacaattgtcccagagtgcacagactaaatctaaatccctacaatatgttttcaatgaatttatgccacactaattttctaatttgcaatttttaagtcaatatactttattttcttttaaaaatagtgttttatattttcatactataacatatttccatgatattaaaattggcaagtaaagaaaataaaatatgtaaagtcattactgtcatcctcccagaagtgatgtgctaacaattagacatatttcatccccagtttttttctacagacacttttgctttaccatattgtgtacttgggtctattttcaactctgagccacttgctatattgaacagtgtttctacagacaccgtgctgtttcttctttccttctttcactcaacaatcatttactgagcattttgagaagaactgggaggacagcgatagaatgcttttgcattttatctgcagtcaactagttagaaaccagaaacaactatcttgcatctcactatcttgttatttgcacctttaaaatccctttgcagaataggtgcatagtattaatttgataactaaatgaaaacaaaatggagttcatcaaagtggatttgttttgaattggcttggagttactggcagtctatgatgacatacgctactccccaccattgacacatgcattcaaatgcagatgctatattagtctgttctcacactgctaataaagacatatccaaaactcggtaatttataaaggaaagaggtttaattaactcacagttccatgtggctggggaggcctcttaatcatggcagaaggtggaggagaagcaagacatgtcttacatagcagcaggcaagagagcttgtgtaggggaactgctgtttataaaaccatcagatatcttgagacttattcactatcatgagattggtatgggggaaatcactcccacaattaagttatctcaccctgaccccacccttgacatgtaaggattattacaattcaaggtgagatttgggtgaagacacagccaaaccatatcagaggcacacacaattttatgtgtttgtgaagaaaaggcaattgtggaaactttacttaaaaagtgtaatgtcaatctcatgagttgaggacagttaggagaccctgaaatgacacctgtgggcttgcattttattcttggtcactgctaaaccatttttcacttccctctgtttcagtaacctaaaaatctagggttcacaaaacaatgagattaaggaagccaactgataactattgtaataggataggaaatgtttcctgatttgggaaggatgggcaaggaggtggagaatgagcttccaaggcagttttgattttccggaaaaactcatcttaaaactgattatctccccaacatgagacctaccaactgacctgtatcagcctaactgcaatgtatctgtctaaagctgttaaacacagctattttcaaaacatttatccattttcataaaagatttcttaaaattcaagctaggttttcttcctttatttgaaaagggaatatggtaattttaggaatatgattatatatgcatatgtggaagagaagcagaatacttaaaagacaagcatttcctctttttatttgagagagagaaagagagagaaagaaactcctaggcaatcagagcagaacattcctaaccttacatttgatccacccattgagctactgaataaatgcttaatatgtcagtgagcccacaagtttcttgtcctgggccctttaaactgatatatctcaatcacctttactgaaatgttatcctgagaagaccgtaaacccagggctgctcaccactgagtcttcttttatgaaggtttctcaggagaacatacagctaaagatctctaacatttttcctgagtagacctcttttttctcttcatgaggatatcataataaatgactcgttggtaatttatcagagcttgttccttccccaacccattctccttaatgcattttttaaatttatccagtatttgaaatgcagaagtccaggcttggtaggaacccagaagagaagaaggtgaaagaacaaaatgactgtgaagctaagaaatccagatttggaaggagtagcatcctcacagatgctcacagaagtccatatgacactccttgcattgcctggggctttatggaagaagcagggtcacgcaggattagtcattgcccaaagagcgaagagcatggaactcgccaatagcctgcaaactctttccttttggcttttctagcacttactactcttttatgacttttactttacttaattttcttatataccaggaatataaccaaccagggtagttgggggccattgtgtattgagcactgcccaactcaattcacttagcttgcaatgtgaatggcttctctcttctagaggtgctcaaggtgcaacccacataatcacacctgatagccatgttgtcaatgcccaatcacattttaaacacttggagggcagagactatgacatagagaaagatttgaatagctattcacagaattcagttgagctgaaaaagtcagaagaggagactagtttcactgactacaagaaagagtgatttggttttctgagagtgaaatcttcccccacaaacatgtactgtttggcaacatgtttttttaagcctttagaattgtaatgctttttgctgggtcatatgttctcaaattttgcctcaagccccatcattccctgttttattatggtaagcttattcacacatttatatacctgccaggctattgtaggtattttgatatgtggcttggcctttctgggcctcatttaacctctctagactgcagttttctcaactgaaaaaattcccatcatatctgccctgcctatatcatgagactttgtgacgattcaaaggagcaattcaggcacaagctgtgtaaaggttacagaacacaatatagactacattatcattaaactacttgatagtcttatgactatttttatggtaatgaaacgtaatccaatgcaacttcgtatatgtaagtaaaacttcttaattcttgtcttgtaaaactgaatcttcatcctttgactgatcaactgaccagcttaaaccttggagaatcttaaacttctgaacacattttacttctctctttatgttcccctgtggatctcttatgagtatacagagattgagagtccaccatacaggttacctttcactcaagaggttgtggcatcctattcattgtcaactactggactttttcctccccgtcgtggaaaattggtgtcacattgccacatggagcatcccttcttcactcttgacccttccttcatcaatggtggagcatcctcctgaagctggagaagagaaatataaagctatgtgtttcagaatgaaaggaccaatcacaagaaactctcaagccttaaaatacatttagcttttggatataatacatcacatctgtatttgttagtaacatattaaacaaaatgatagataaaatgtagattatataagaacctatgtaattgacatgatttagatactcattcaaagatgagtcatgaaaaaggtacggtattgtcattgcacagtatttcctatccctgtgacatatgaataccaccttcaccgtttttgtagtattcactcatcacttgcactgttatttacttaatagtcttctttaagttgatttattttacttaaatatatttattttgaaagcaaaatatataattctaaagtaaatgaaaagtcggtattacttctcataaataaaaataattgtaaaaataaaagctttaagaacaaattatgttgttatattttagctatgtattatagcctgacaaaagacaagaattagtcctcatttaaaaaaaataaaggagattggcagattttaaaaaggcttttaaagatatataagtgcttattttctctctgaggaaataaagagcaaaagaaaacttaaaagttaataattttgcataagtataatttggaatgattcagtgtattttttcattatgacttcaaatcatttaatgtatcaaaaacatagtcataaacattggggtcatcatctattttgattgtagagattttacttttatacatagatgttttcaacaatataacctaaatttctgggaagttatatcttttacatttattttaaaaatctctctcttccctcacttcttcattgaagtaataagggacttaacttctttaaaccaaagtttccattatagataataaaacaaccatcacaacaagaaactactaaatgattatttattcagatcccagaagaagtgctttacacggatactctacttcaaccctcacaactgctccataaagtaaatgctattagagtaaccgttttacagatgtgaaaaataagtcttagagcaatttcttagtttgctgtgatcacacagctagcatgtcaggcaatctgatctggcacctgcaatcttaacctttcctgaaataatcttattacttaaaaaagtattactaataatgataagaggctatatttcattattttttgaaaagtatgtttatggtctatgtcacaaattaagagtgacaatcagaaactcctgtaccattggaaaatgaaattttacaatttggattgctgttcaggaagcaaggttaaacaaataaacaaaaataaacaatgacaaaagccttttaatgaccattctggatttttttttcattttaaaaatgaatgctcaatgtttcttcctcctagtgtattgctttacttccttaacagaatcctattttattaagaagactgtgaagacaaattttagactgaggttctgagagatgtcttagagccagagaaaaatgaaaaattccagaagtctacagaatccaagtaaagaagactttgtttggaattggcagcaatgacttccactagtagcttaccatgctagtgtaattaatctcactcccatttctacttctttttatggcagaatttcttaacctcagcactgctgacatagtgggtcatatacttcttcattgtgaatggctgtcctctgcatggtagaatgtatagcagcattcttgggctctatccactaaatgcccagagcatcccccaagttgtgacaataaaaggtatttccagactttgtaacattactctggttaaccacagctagagattacctcaacttgtgatacttttctgcttattttggtgttaattggtatctgccattgttgctggtggtcatgttattgttgttgctttgtcctttagtaaaggttccttctctgcttagagacaggacatgcttagaaccctttgggtcttaataaaacctcttttaatattcaaggtatagcagtgagatataaaaatgattgcatattgacatatatctaaatattttcactttgatttcagcattgaatcaacatctctatcagcttgtcttcctggagaaggatattttttggaggttctggtcaagctcagtggttactgaagctgtcgggagtcttaccaccttggggtcactgtggaaaccagaaaataaatggacaaagctgggattgctttttggctagtataatatttccagaatccctgaggcttgcttttaaatcagcataagctggttttgtgtctcacttttgtgttgtacaattacagaaagcagcaaatacttatcttggcatgtcctgtcatgacatgagccaaaagctgtcatcctcatagattccctgtctaagggaatagttgccctatcagcatttgaaagaaacactcctgaaaccttttggagactctaaagttatgtactgtcatttgatggataagtgactcaaaattcatattgatcacatcatttcaaattcttacctgttagactggtgagagaactctaggtactttgttgggaaggatgatggagaagagagaagtgaaaatatgaaggattacttataacaaaagacttgagaaatattttaggcttgagaagcattttataagggaaagatatttgtgatggggactagtaagtaccacttttcacctattgccatttgaaaattgactgtttgcatattgtttttttctgaaatgccgctatgcagtcagggatgagaaggggattgtgattgagtaaagatctttcttagaatcatgtcctcatttgtaaattgtgattttctgtccattaagaagataataatttctttttcctgacatggccttgtatttttaacttcttgctccacccatactcaaatgcaggttgatttattctcctttatgctaggtgacttccccctgtgtatactctctttcagaagtatttctttctatctccctaaaatcaaaaccaatgttcaccttaggttgtgtagaaaagtctctgctaaggcacctcacacctttctaaatcacataagttataacttatttatatatttactttgaagtaccattcctgaatatctaatagtgagattaatgagttggttaatgtggtatcaatttagggcagaaatcattttgaggaactcataaatacctactattatgatgtatgaagcttcaggtttttatggctgccactcaaacaaagaaatattatttggaagatgtgatttgatgttagtatttaatcaaatgtacttatttcacctacttgctgaataagcacccttctttactaccatcactggttttcatattgaggtatgtggatttatcctttatcattgctcacctttgaagatggtggcataattaaagaattacaaggggatttcagaaagttgtagataaattgaactaaaagataaaaatagaaaaaatttatttctcaacataagctccatcgggttcaagacatttttgtaagctatgataccagtgatttagtccatccttaaagaactgaaggtcctgaaaatataaccatactaatgcattctttttgacattattacctgaagaaaactgggtgccctttaaagaggttttaagattaggaaacaaagttaggaggagcaaaatcagggctgcaagatggttgcctaattatttcccatcaaaactctcacaaaattgctcgtgtttgatgagaagaatgagcaggagcactgttgtagtggatgaggactctctggtaaagctctcctgagtggttttgtgtttttgtttgtggtttgcaaaagctttggctttctcaaaatactctcataataagcaggtgttattgttctttggccctccataaagtcaatgagcaaaatgtcttgaacatcccccaaaactgttgccatgacctttgttcttgactaatctgcttttgctttgatttgaccacttctacctcttggtagccattgctttgattgtgctttgtttttagaatcatagtgatgaagccatgtttcatctcctgttacaatttttcaaagacatgcttcaggatgttgatctcacttgtttaaaattttcatttaaagctctggtcttgtcttcagcttatctgagcacagtggtcttgacactgattgagtgaaaagtttgctcaactttaatttttcagtaagcattgttagtgaaccaattgaggtgtctatggcgttggctattgttcatgctgctaattgatagtcctctccaattagggtacaaaaagattatttttttcttcagaaattgagtggatggtctgctgctgtaggtttcattctcaacatcattttatcccttcctaaaaatatccatttttaaactgctgatttattttggccatcgtccccacaaactttttgtaaagcatcagtgattttaccattctctcacccaagcttcaccataaatttcatgtctgtccttgtttcaattttagcagaatttgtattgctctgataggagcacttttaaaacaaatgccttttctcttactccctcaaactagatcatgttcagacatgttataacaagttagtacaagtttattttgctacaaagccaaatagaaatttatgcatttttttcttatatgcgttttccacgaacttttggaagacccctcatatatccatctacatatatggccagtgctaaatctcaatggaaattgaagacacagcattactcattggaatgaaatggcttgcaggaaattcccaaagctggctagaaagagttgaggtaacctcttccctcttcatggttccagtatcacccaaagcttttcctcctcagcactaaatctttgctgcaatactccttcttcagaggtgcttatgaaatggcctcatttcaaagaatgaaagttaggttgtagcaggaattttgaagcccagaactttaacataaatagttgaaaagaagaaaaataaaaactctttatacaaattcttaatcttagtttactctgtgtgttaaattgtcattgccataatgattttagtcctttctctgacctggattctcccactccccagcttttaaatttagtccattctatgtagtgcctcttgtaatttagcacattgtaggtgccccattagttttgttgctttattcacctgcatcctcacacatcgtgtgattgtgcttgcagagcacactgaactacaacacattctctcactctgaaatctgtcaccataaagcataaagcaaaatccttccctcctttactgaatggatggctgggtggatagctgttctttgcacatgttcgtgttgagtaggtgctgtataaaatcacttgttctttttttaacgtgactcacgaaaaaattatcccagctttcagtaatctcaaggaaaaaaaaacacttgccatctgcaatttactgcttttaacctgaaaaataggatctaaaatgatactcagatacttaagaggcttcacgtgttgtaggcagaagctgacagatggcacatggtggtaggctgttgcctcataaggagggaaggcagaagcaagtagacagtggtatggaaagcttcttgggaagaggtcatgacaacgcttcaaccagagataattaattatttgctatattctgtaactagcctgtttatacaaatagctggtgtgctcagtacaacatagcagtgaatctatggaaaaggaatctgtaaataataatgcaagggaacttctcttacgtctattgctaaggggattatcatagcattcaattttaagccatgtaacctggaatgcttactaaatgtgtaattcttgttcttcctcttcatataatgcacagacttgaattcctatattgagagaataacttacctcttttaaataataccataatttgccttgaaggtagggaagaaagagagtgaagtggggaaaatttcaaaattctgtcttccagggagcatattcctactcatctgtgacgtctaatgtaatagattttgaagaattatttgtaagatagatacttggagaagtttatactcacttcctaatcccagactatagaaacttctgcattctagaatttcagagaatgtgtctctgtcaattgtattctgaagataagatacatttgacatttgattgcttcaatcaacattctccaatgcagatcactaggcagaaacatcttgacacggcatatatttgatacacaatgattatttgcattgacttttaacaaagtcccatttagaaagattgaaagaaaaggcaaatgtgattggatgtatgctaaagcgtgttcagtatgtgttttgaaatatctttgaaagttcccaggatgtggcacgtatcattcacttgaagctgaaaatctctcagttgagcaaaaacaagtatttgctttgttccatgatgcactccacgtgtgactaaaatggcaaagtgaagcctctagtttgtagatacttgctttgggagacagggagctgtccgtcgtcctgaacgggtcatgctttaatgaggatagacacagggtgcaaaggaaagtgactgggatcccctgcctgcactgactttaacaataaagatactggaataatgagatcccatggaatttagcaaaatacgagtagaaacaagtggtaaagacagcccagactgtagttcaaagtctaagaacatctaagctgcgggttcaggtataaaattagggccctgtggcttatctcaagacagtaactttcaaaggggggtttgaatagtctttccaactgtagctacattacctgaggcaattagtttacttattttttgtttttgttttttttttttgtggttagcttttctttttttttaatttattattattatactttaagttttagggtacatgtgcacaatgtgcaggttagttacatatgtatacatgtgccatgctggtgcgctgcacccactaactcgtcatctagcattaggtatatctcccaatgctatcccgcccccctcccctcaccccacaacagtccccagagtgtgatgttccccttcctgtgtccatgtgttctcattgttcaattaccacctgtgagtgagaatatgcggtgtttggttttttgttcttgcgatagtttactgagaatgatgatttccagtttcatccatgtccctacaaaggacgtgaactcatcattttttatggctgcatagtattccatggtgtatatgtgcatccatcaaaaagtgggcgaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaagatgtggagaaatagtttacttattttttaaggcaagcaaggtgggcctgattgttacatgaattaccaaatctaatgacaaagccaggtgccctggtactgaggctgtgtctcctctactccccatttcctcccctttccatcactattttctccaccctgcctatcctcatttctctttgctcctcctctttttccttctactctcttctatcctcccattcttttatttctcctctcttacatcccttccactccctttccttctcttcctttttttcttctctctgtctctctgcatgtgtctgaattaactcttgagtcagcatttaaatttggtaattgaatgttatgggtctttatgggcttcactttgggagaactgcttttcaaacagagaacctgataagtggtggaccttagggttactttgacatgtttacaaaaataaacttatcagtagttttagagactgccattggagcaattatagtctatgctcacagaggcttggtaggcttaccacaatccaacctcactctcccatcattgattctctgctctgtgaaacaagtactgtactcttcttcaagcccaggtgaataaggcttttctaggaaattctttgggattataataaaataattccttctatgagaaaggagaaaatggtggcttttggtcttaagtagattatttaccatctctctcaagagagataaaccataattcttaacaaaaccatattctaatgaagtcattggtcacagtgtcttctatcccaagagagatgcaaattactaaattcctgtcctggtacaaatataagaaatccagtcatggcctgacaagtttgaattccttcttgtccttgatatactctgtttacccccattgtaatttatctcttccttattcctccatattatttaatttagtaagcaaatgtcccctggtataagctgtgtgaatattataactgaattactgtctgtttgcttaactcattacagaaaactatgataaggtttttaattacaaaattagccctgccaaatgaatttctttcattcaatgaactgcaaaaggtggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacctacattttattctcagccttgtcttgaacatcttactctgacctcactagctcttcacttaccaatttgtttctcatcttctccttaataaccttatgaataagttttctatgtagtcccttgtattgctctttagacctgtcacttatcacttcttcttcttaggatactcttctccactgtaattcttatgtctactctaactatatatctttgaattctttagcatacataaacatatctgataaagcaggatcaagcacaaagatgctgtatcttgcctgcatccaacagactgggattattctgagctctcaagcaaaacatggttaaatcctgacaacaaaatgaagtgacatttatgcttacatatatccttccttgttttctgcattttcatttgaaaagtaaacatctagtccattttgtttatgtgtctaataatcattttattttactttaatttctttggtaaaagctatggactatggccattgcagaattatcataatttccatggagaaacttctgacatattttaccaaatatttttgaaatgctacactcacagttaaacctagagaggattaatttgggaaaagggactactttatgaaaatgtgggaaattatttctattctttcccttttgtcatgcctatttccctaaaattagattatttatactatacaagtaattaaacttatttcaaaatctaaagttaagagaaattaacaggtcattgctcagaaaaatgcatagtaattgtgagttttctaagactgtcacaacatttgaccaacagtctccttactgaaattttatggtttctttctctagacaaggccacatgcatatgaaagcagacttaaaatatttttacctatagctggaaaatcaaatcataaatggcaaactatgtattacttatgttataattttggagctataattttggagctataaatccaggatatcagacttttttcccactaatattgtagtattaataaaaaattctcttaatgtgtttgcaactaaattggcattaatttaatgaattctttctttgaacattcctcatttttagccagcggttggtggttgagttgcaaatggttattgcctagtaagagatggcctatgaagaataatctatttcactggatcccttggttaggaatgtagcatatgcttgcccaggtccacttctaaggaccaggtctgtttctccttgctactgcctgaaatagcataataattaattcaaaagttggctgcttttcactagaagtctttaggacattgtaagacaattaagtctgtagaagaatgagaaggaatcttttatttgaggtctagaggtgtcataactgtgaatcacaaagttgtggcacaatgcattcacctcagaaaattttcttcatgaaattaaagtttcattttgtcttaaagaaaaggttccactctcatgcgattttgtgtgttctcatcaaagcaagaatctaacttcctgatctggttactgggaatctatgcagacacacacaatccaacctctggggcctgttttgcaaacagtctttatgtcatgatttagaatactgcataagaaatttctccttgaagagagatgactgcttttgacagttggcttttcccagtgcagtcattagactgcacatgactgatgtgtgtgcatggacagggaggggtcttcattccctggaactataatgtcaggtttcatattgtctgagatcagcatctcttcagaaacaaccatgtactcctttctccccaaaccaccttccctcctgaccataactggttatataatcttgcatcttctattaccctgactgctgatccgtgcctgatggctatgccaggtctcacaacaccacgagcttttgattgctgcactctaagctgcttaataagacaattaaaaatgatttacaaatggccatcacaatgcaactggggatcaggaagagaatgttctatttgctccaatattaaaaacgcatgcccttctacagttccttctgcagctgcctttgatttcagtactggtttactccctttttagaaattatttttttgatgaatatcatgttaaaatagttcctcctaaataatgtatagctggaaataattcaagggatgtgttacacatgctaggtggtctgaaatcttcttccctttggtggggtaaacactgcctagaattctggagtagttaaaaagtagtacaaatgatctttcatcatgccggctccttctcagtttgagggtcaaacctaatttaatcactgacacatccatcttgagcatttcctctttcctcctattgttgcattgattaaaatgggcaaatctcccaaagattccattgtgagtcacacaaacgttcatctataaaaagtggaaatttatcagaaatgatgaccttgatattttgaatgtaataactgagaaattcaagtagaatctcatctagtatgtgttgaaaatgctcattttttgtttaattttgtttagtttttttttcttgtccagaggaatgaaaattgatattggcccaaatattaagaagattctctatttttagtgctgagacccaaggattagtaagatgggcattggcagggttaccataacttttcttaggaaggatgtgtggaatagattttttaaaaagaaccatctttgaagccagatatccctgtattttattcttgcctttgttacttagtaaagtgtaggactttgagcaagatgctacatctatctgagattccattttctcatctgcaaagtgaatacactaatcttaacattcagatttgctatgagaattgcatatggttatctttgtaaataaagtgcctggcacacagtaggtgctcagaaaacattgatttcttttaatcctctcattcaagagcacagatgataaaatatttatcactgttagtggtgttatccctggtatatcctggcaaatgcagtgagatactaagaagtttgatgctgaaattactttttcagcactagattattacatttttatgacaatttgaaaattaacctatcctatgtgtatcaatagcccagttttgtgctattttcaagtaatatgaatgttacagtgatggtggccacatgatatgttatgaaggaattttatttacatcaaacttcccacaatagcctgtttattgaattatccctgaaataaaaccaataaacctgtctttggaaaccagtgaccactgacccacttacatgttatggatggtttcttttctgattgccagttagtgtgattggggtaaggaggaggtaactagtgtgactttcttcagggctccccttatactctatgtgtcttctctccctagctgtctaaagttctcttcaccttgaagagcctcccatatttaacagtttatgatggatgaccagcccacattagggcactgttcaaatttcagatactcaggaaggccaatcctcagagtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttctcatgggattttcttcacctaaagttacaacttattcttccttgtcagtcccacctctctggagctgccaaaagctccctcttgcccctacctgcttcagccagcattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccataacttatctatctgagctgaaacagaatcaatgacaatagtggcataagtatccaatgattttgagctaggccttgtgagtctctgactgtaaggtcaccctccttatctcaccagtgtgctgagccttacccaatcctcagcatatcacacccatgtactgagtcactctgcatcaatcccacgttggggaagagagcaaatctattggcaggggataatacaggatggaattagcacaaaggctcttctagtactacaaaatggctttcttgccatctacttgacccagcaaaactgttgtgtgataatatttaccttaaagttggttgttagagggagatagttgatattcacatattagatctcaatagaaaaaatagatagtataggggaatattttttactccataccaaacttaataatttaccattttctatgaaagtgtcttacattctacttctgtattttaataacatgttaaaattatgataattatatgatgtttttaaattttttaggtgcttttctttttctaccatgacaatgctaagtttctcttcctgattattcttgataatattctcccccacaaggccaatgttatctcctgtttcttccctccactctacctaggctggtttcctccctgttgactgtcctatcatgcgtgttcatctttgtattcttcttgaagcctgtgatgactttcactacattctctaccttcgcaaatgcagcatttccttcaaaagtcagttccaagtctttcctggacacaaaaatcaccacttatgtttctgtatgtgaaatttatcatgaaatgtaatacctaaatttatagtatgtggtatcgtttcctgtgctactaagtgcattactttgcctccttcattagagtacaaattcctccaagttaagggaacatggagactatgggcacttctctgattcatgtgatgttctcacaatattgaacatagcacatgaaagaatatgtgattatcagttggttagtggctggcttgctttggatagtcattcattcattccttaataatggttttctagactgtgggttacagatgctcccttccatcctcagtcacccttgaaaatatgttgaattacatcttacactttgccttagattagcgtttgttactatgaaagaaagaaagattttctgcctttcacagcctggatcctactcactgagactataggctgtcagaatgctacatgctcccagccctttaactcttttcactctgctatggccacaactggaatacaccttttcctcaattacaaaagccacacaagattctacctgcagcctcagtacacttcaacaattctcttattagtccttttgtaaacttactacctaagattttgcagtccctttgatgtctatatatcttgccaatctatcacttgaaggtgcctgttttactccaatgacaaaaaaaatccaatctaatattttttcaccttttctttctctgcctcagagttgataatacttacctttgtcactttcgtctcacctaggtccaggcatgagcatagccctgcttcatttcaacttagcctatctttatggccttcaggtctcctctcatctggaattgagttctgtagattttgtcctgtatgcccataatccactaaatagtgttcccattgttttcaaatataattcacaggggtaaagatagaaaatgtattttttagggctttttctaacaattatattttccatggaatgctgaagtcccacaaggaattctgaggcccaggtaaggaagaagaattagggaagacacaccagtgggaggttgcctagggcacaccaaaccattgcaaaagtatagtaaatccaggccaatccacaggtgagattgagactacagaatacattgttctttggttagaattggcttaacaacaagtcaatgacctaagctagggtaggcataagctggcgtgtcttatctcttatgcaaaattgtaagttctccgagaatagtcttccacacttagcatattacttctattacacattttaaaagataattttgattgtatgggttaagttaaatgtactccatgctcaacgttaattgatgaacacatatctattaagcactattgtggaaaatctatttggtgaggatacacaggaactccaaggaagggtaagacctttattctgcattctaggagtctgtaacatagctgaggagaagaaacacccagtaaaaatgtgtcactgaaacttaaacaaattatttaacttccttaaaaagtagtttttaatatgaaaaatgggagattaaagttggtcttctaggttccttagaattctagaactccaagtaaactagatatacatgtgtccatacttatgtcagatgggtgctatccacagtaggtgctacagttatgcagaaaataaagagatatctggaaactggggtagatatacattcatggaggtgttggagtttgaactgagccttaaaggaatagtcttggaaggaaaaattattatccatcactgaataacgtgggcaaaagtacagggaaaatacatctctacttttttttgttgttgttggggcaggcttcagccaaaagagcatttggaattgtctcgacttttccctgctctagacttctcctgtctctgcacatttgtttctgcattttcagaatctagctattttagtgtaccaaatctcttaaaaggacctgtattcattgtgatacaacccctataggaacttgagataatcagaatttcaagagaaaattatagtttcttggtgcctgaactgacccaacctcatgggtttaggatactaatcagtggttccctggatcagttatctgatcctgtcaccaatcaaggacaggactgtcacgtctcaaaatactactttttcaaggggaagaatatttctcctttagtatgtctcagcggaggtggaaaatgcaaataacctttttaggagccctttaaacacatagactcctcacttagggcccaattagtaggaacaaccaacctactctacaaggttttactcttcccttgaaattacacttcaaaaaaacatgcactgactccccccaggcatagaagcaggatccgtgttttaattctaaccttaattaaatctttacacaaactcactatttggctgtccaatgaagaagggcaagtagaaggaaggaagtgaagagcatttgctcttcctctgtcttccgtgagggttatatacccaaaactctctgtcttaatttggaatagggggaattagattttgtcataaagtcataagagttgtgttataagagtacgtgtatacagtagttgaaatgagtgcccagaaatcttcctagtttcttccccacctgtcatggagtttcattgtattaccttgcacttaacaaagccaaatcattgaaagatacagtccctccatgaacaacaatcaattctgtaactgatccttacccatctatttcaataccatgcataatgacactatcctttggaatgcagggaaaaaaattccaaatgacaatttgtcttaaatgtagacagtgctttaaaatatatgcctgatcataagagtggatatagtatttaagtgtgtcagaactttcttgctcttctaccttcctcctttttggttattgttgaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaaggaaagtaaatgtaataccccagtacacctaaaaccaggattaatgttttactttatcttgcaacagtactaaaattaaaagcaaaacaagacacattttagatatgatacagtgagcactagagaaaacctcttttattgatgggagcatattttaaaatatcttctcacctttagtctttgggttagtctcagtccctctgcatagggagcaaacaatacatgaagaactatttgggggaaattgctataaagaaacaataacttgctagggaaaaaaaaaacaattaactgtgaagcatgtatccctgaatctgaatcatggccataatacttattagtcccccaaatttgagcttccattgccttacttgtagaatggagaaaaaaaattcctcttgaggtgtcagtaaaagaagatgaatgtatccctcatgtttattctgatcagattatttttattttttgccttatggcatttacctttaacaattttgaatatctctgaaagaaagggagaaaggatggaaggtacgaaggagggtgaaaaggaaggaaggaaggaaaggtctttgttttccttacctggcacagctaaatattggcaaatcacaatagatagcaaaaatctaaaatacctaggagtacatttaacaagaatttatatttttaaactataaaaatgaataaatactatctaaatcaaagactatggttttgagtggtgacaatttaatatcaaagtaattccccactacatttctaagtaaaatctccctctggtgtctttttcttaatttcccagtgttcttaaaattcctatggaagaataaatatctgaggatagccaaggaaaatataagtaagaagactttgagtaagaactatgctttataattctaatataaaaccattgtaataaaaaataatgtatgaacctggcatgaaaagtgggcaaatagattaaaggacaagaattgtagctcagaaattttccccagcatacatggaaatttaatcacttccaaagctgttatcacaatttagtggagagatggaaagtgtttttttggcaaatggtagaaagataaccaaccatccatatagaagaaaataatgttggtgcctatctcacatcataaacagaaataaattccaagtgaattgaagacttaaagtttaaaaaattattaaaaatattggaagaaaatttggactagagatacaatctagtgattggttgaaacattgctaaccaaaacaagaatcctatatgctataatcttaagagaaaaaaggtcaacatataaaaagtttaagagaaatttaggccaggcacggtggctcaatcctgtaatctcagcactttgtaaggccaatgtgggaggatcacttgagcccaggagttggagaccagcctgggcgacatgatgagaccctatctttacacaggcacacacgcacatagctgggcatggtagtgtgtgcctgtagtctcagctattcagaagactgaggtaggagggctgcttgagccaggaggtaaaggctacagtgggccgtgttcatgcccctgcactccagcctaggtgacagagcaagaccttgtctcaaaaaaaaaaaaaaaaaaaaaaattacaataaaagatatcattgccaaattcaatatgtaaattatatatttggaaatgtaataaaatgtgtccatgagaattacaagtagttataaccaaaaacccaagtaactgtggcttggacaaattaggtgtcttaatttttgacatgtaataagaagttggaaggtaggcaatccagacctcatacaatgactccatgtggtaatcacaaactgagctcattctacctgtctccttagctgtcctgactatataggctttcatcctcatatttgtcacttcatgttcactgaatggcttctccaccttaaggcaggaaataaaagaaaacaggaaggtgaaagcaaaaaatgtatatgtgggctaagtttgtatcttttaaaagaagagacccagaagtctcttctagtaaattatggttatatatctttatccataaatgtgtctatcccagttgcaaggacaactggttaatatgatttgttttgtaattgtttttgtttctctaatctgggcatatttgcaactttagcattagagttattttactatggggagaagggcaatattaattccagaaaggtggctagcagtgcctgccacacaaatgaaggtagcgttaatgtctagactctacctaaaatttttgcaaattgataactgaggaaaacaacccaatagaaaaattggtgataaatatgaataaacaattcacagaagaaaaaattcagattatccttaaaccaatgaaaagatgcccaacctccttcatcgtcagacaatttcaaatttaagtaacaatgagatgttttgtattcatatgattggcatgaatttaaaagtgtggtaactcctattgccgtttgagatgtagaaaaattttaaattgttacagcttttttttaaaaaagattaacttttgaatggcagtttctattgaaagttttatatatatatatatatacacacacatatatatgctttgatcagaaatcctaattatgagactctcatagaaataaaaataccagtatctagctatacatacccaatattgcatcatattttgcggtggtttaaaaaaaaaaaaagaggaaagattaagtaaatgttcactaatagaaaaatggaattaagtaaattatagtaaatccctatcagggactattatgcagtcattttgcagaatggacttgatctgtcttcatctaaagcagatgacttagaaatatttccacaatgtattgttaagtgaggaaatgagatagtaatggagaaagataagaatgatgcaggttattaatctgggtggccagcgcttggagagaggaaggggagcaataggggaatatggaatggggaaagcaaaagaaatcaaattttagatatgtacacaagtaaaataacttagaattcagatttcctttttttttttttttttctgaggcggagtctctctctgttgcccaggctggagtgcagtggtgccatctcggctcactgcaagctccgtctcccgggttcacgccattctcctgcctcagcctcccgagtagctgggactacaggcgcccaccaccatatgcggctaattttttgtatttgtactagagacagggtttcactgtgttagccaggatgctctcgatctcctgacctcgtgatccgcctgcctcggcctcccaaagtgctgggattacaggcatgagccaccgtgcccagcccagatttcttttttaaaagacctgaaataaggaagagaaatcatagcataaactaagtttaacaagatcagtgtgggataaagaacagaagattgagaatttttttggagctgttcctgattagatgttagaagattttggttatcaccaatccttttcagagaaaaattttataaacttacaagtatccattgcacgtgctttacatttgttttatatcaatatgactgtaaactttatagagatctttttaatacatgaataggacatcttatttttaaggcaggtaaatgtgctttttctcacttcaaacaaattatgtccacaagctgaataatgagaagggtacttcatagtgtatcacactgccgaattacacgttcactgttttcatccttgaaaaccgtgggctgcttcagagtgggaaacagtcttcactgcttataactgagttccagaattttcccagccatctgattcccaagcccagagcttcggcttctgggttctgttgctggcagtgaggaagtgggatagcacattgtttaaatcacagcacttctctgtttcctggctaagttacaaaacagtgttgtagtcgtgaaactgaatatcatcagcacacatttgtggcatgcacagagcatgcacgactctgtagtagcgctctaggcaagcttatgatggcttttaaaagaggtgttgttgcttcctttaggaagtttatgaactaaaggaagacaaaaaccaaaccaaaccaaacagaaagcaatgcattggactttccatcacagcaattacatgtctgattctgggctttgtgcctattaatactcagtaatatccattgaatatgtgaacgaaccaaccacgttaacaggaactgtactgttatagcaattcttaactggaagttttgtcttctgcctcactccactagaatctatctccatccagttgaatgcaaatctgataatatttttttcctatggtttccagatagctttaggaatcagaaagaggcactgattgtaaacctgaaagtgtgctttgtggagcctgcatgatgttttaaataattgaattagaatgccttttaatgagcggcacactctctagttttcccacagaaaacctctagcctatggtgttgaataggtgatcccccagctacaggataaaatcccaactcctcagtgatgtacagactcttcccactttatcccttgcttattatttcagtcttgagtcccaccattttgctatatgcaaccggcactctagccatgctggattgtttgctgtttcctgaatatgctgtgctcgttcagtcctctgcaaatgtacttatgctacttctttctcctgaattgcttattctgtctcattaacctagtgtactccctcctacccattcatgttcaattaaaatattactgccctcataatatcatttttaactgacctagaaaaacaagttagatattcacatcttcaatattccatctatttatcaattgttgcactttttatattgatacttatctgactcttcacccatcagaaagatggagttctctctttgtacaccttgcacctatcactggcttcatcacaggatccctatcacagtctttttgatgaagcattgttggatggatagatggatgcatggactaggtgataaatgaatgatgaaccattaagtgaaataaggagtgtggtatagacttggaaaagaaaagttactgttgaaatagctctagagaaaaatattttttaagagttgtataggataagatgaaggtgaggatgacttatctataattttatctttggaaattgtgagttaacatttgtaaacagggtggatattttggagagaaggtgctacataactacagcacaattatttattatcctctaaaatagtccctttctttggcatgtttaaaacctaaagtctggttggcgttataaatatgcatgagctgttgggggaagagagcataaagtgtgaatcacacttcaaacagacccacccgctcactcccgacttcaagtttttcagaagtgtgaaatgaaaatgctttaaaattagaaaatgtgccatcagaacttttatcagccctcggagaaaataaataatctctaaatgtggggaatgctggggatatttatttagttagtttcacagctaagatgctttgataaatttttgtgtcataaaatgcacaaattaattttaatgaatgtggaaacaaataacttctaaaacagcctgagtacccaaggctgcaatctagggtttctgagggattattgaaacctaatctatggacaaattgtctcaatggggaaaagaaactcttacaggtgtctttccctctgatacatttgcatttgaagggtgatcttgtagcatttgaggagtgggtgaatttctggaaagagacacttggatcttaaattgctaaatggtaacgaaaatgagagaaaatagtacagttagctgtttgctttcgagtttgtggaaagtgattttctaatcaatgttactcttgatttcttaagcataacaagattaaaatgagtgtgaatataaaagatcatgataaaagataaaggatgatgacctgagatcttctttattttttattactaatttgtttgaagaatagtccatcatttccagtaactttttgaccaaaaaaatggctatgtggttgttgccatcaaggccagtaatagagaagagggacaaagagagaggtgctccattggtatcctcaacctgtgtgtagtacataggcatcactgggtgggctggagctagcccagatggctgggctccacccaggtttcctgatgcagtatgcctggggttgggcagcctgagttgcatttgtcataccctcccaggtgatactgatgcacactttgagaaacactgctctgttccaatacttacatgcaatttttttaaaaaaattatgtaatgaccatctgtggttaaatgctgagctcattttataaaccttaagcgtcttggcaagtgtctctgtcttttttttaattgtctgataatttaaaataccattttattagcctactattgtggaagttgaaactctattatattcactctgttattgttaaccacctcacattttctgtggtatcgtagaacagaaattgttctaaaggaatggaaaaacaacatttactttcatcaaattgttgtctagcctcttgattgagttatagctattgttactaatttattgctagtttttacaacatgcccatgatttttttctgtttcagactgaaagtaaatctgaatagatgaaatctaatttaagtacatgctgttaggttctgtgttttgggggatagattaaaaatacaagagaaagcacaagacaacatgatctctcacatgtatacatatgttcaactgcatgtcttttgttgataatctccaaaacatacatattttgacttcagtaccataccagatactggaaaccaagtgataagatgactttactctgggatgtgaatgtcattgagtcagcagctttctaccaaatcattaatctctgcccaggtccaaattgcttcagtgattttcctaccactcagcattttccttggtgaaggacccttccaatacaagtcttctggcttttctttctactagagggaaggctttctctcagcagctatttctaaaatgaggctgatgatgagagtgatagatgaaaaaactcatctctgaggtttgtcttcttcttgcatctgctgatagcactcacttctcagctcctctttatacctaaaagatgtgcttctctattatttcaataattctgatgctgctcattctttacttattttcagagatgtttatgagatttcaagctccttaactagacatatacaaagagcaagaaaacaacaacaacaaaaaattctccctggtcttttctggaactaacaatagaatacttgaccaagaaccaagattgcagactatctcagtgttagtggaaccatttcacttctcgatgttttcttataaaacacacagtttgagctgtattgttaatctacttggaaagatattatcattttttaaaacaaatatctgctgggtgagtgttaggcaatggctctcaaagtgtagtcccaggaccagcagcattagcaaattcccagttcccacctcaaacctgctgagtctgaaactctaggggaggaacccagcaatttgcgtttcaacaagccctcccagatgattctgatgttatagcaattcttaacttgcttaagaatttggaaagtcttacaaataagggcaggactgggtggagaaaatggagaggtctgattatctttcatgtaatccccacataatttggtgtctgcaggagacacttttatttgtttgctataaataactgggagcttgccagtggtgaagaagatatccagagaacattgtgaatatatacttagtttctccaacctggacagaccaggagcctttatgtcaagatcctgcacggataattcccctcaggtggagagctggtggtttttccaagcacccagccacaactgccactgcattctatttctttaatgctcaatcagtgcccctggccatttgatgatcattcctccctaatgttgtgaggtatttagtccaaatagtacaatccatgtttgctttctttctcttctagtaaaatgtataggttgctgtaatagcctgtgtctgccccagaccacaatcataaaaataataataaattacctcgctgtctctgggttttctttcaggctcaacatgtggtttgtggcttatggggtattgattgtgcattatcagtttagctcacacactgacaattacatgtagcgccaaggtagccgtgacaatgtagtccagttgccatagcaatgaaagaaggcctattgctgctacctgcaacctgctttatagtgataaacgtgctgcttatttcattttaattgaaatttgaaatcatagtctctagcaagaaataaatggactcattccccatttttcccccttggccacacaaaaacaagtattagtaggaaatatctgagcatttttaaaaagtaaatatcaaatttttgacagtatgttttccagtagtttcactggtactagaaacagatgaagagtgatactttgctgaataaaaattgaattagctctcatgtttttgcattcttaattaactgctattttttatttccctaagtccctcatcttaacagcttaccctgcatggtgtactttatataacagagactttaatggatttacttgctgagtttagttcatatctaaaaactcacagcagatatcataaggtacttgaaaattagaatcacagggcgctgtggaagcttttacataattgaaaaaattgataataataataaatatttagccatgtacggtttcacttctatgccagtgcctcatctatgcctcagacctaataatctttatgtgacgtcattactacgtactacagtcatatacaatctatagtgctatatgtagccaagagagagagatactgtgaaatatggtcaggaatgaagagattctatgtcagtcagtccaaaaaagatagaaatttagtacagaaaaccaaccaactatggaaatgaatagtaagatagtaactaaatatgtatagatgtgtgtatatgtatgtgtctgtgtgcatatatatatatatatatatatatatgcacacacacataggcatgaagtgccaaactatttttaaaagtatgaacttggtctataaagattctaaataggtcagtggaagactgggtcaaatctgagattccactttgaccttttgatctttatctgaaagaagtcagatgatttcccttttctggtacaagcctgtaagttagcacaacattttatttccctggactatgtgaagtatatagtagatatttaggacagagagaaacctatggtggggagtaaaatttaactagggtaatataaaatataggatctccccttaaagagcttatgatgacatgtggctgggcacggtggctcacgcctgtaatcccagcactttgggaggccaaggcaggcggatcgcttgaagacaggagttcaagacaagcctggccaacatgatgaaaacccgtctctactaaaaacacaaaaattagccgggcggatgagggttcctataatcccagctacttgggaggctgaaacacgagaatcgcttgaacccaggaggcggaggatgcaatcagccaagatcgcgtcactgcattccagtcctgggcaacagagtgtgaccctgtctcaaaaaaaaaaaaaaaaaaaatcttatgataacatgaaaacttatttttttataaagtgacctcagaaaatgtgcacagggtggggcatctcatgtgaaaagcatctcaatcattgattccagccacatgccatcataagcgctttaaggagagatcctatattttatattaccctcattaaatcttactccccaccataggtttctctctgtcctaaatatctgcttttagaaggagtaaacatgacttgggaattagatggctcccatctgtgaaaatggattcttaccagtggtgttttttgggtggttgggttataataaaaaggaaaatattatttcccttatattttagtctttcttcttactcctagttataatcatggtcctccaaataattatgatgataataaaatgatcaatatcatgtttaatttattttatgtccttattaatacttactgagtacctagcatgtgtgaagacgatattctaagtcagcagtccccaaccttttggcaccagggaccagtttcaccgaagataatttttccatggactggggttgggggatggtttggggatgattcaagtacattacatttattgtgtaatttatttctattattactatactgtaattatataatgaaataattatacaactcaccataatgttgaatgagtcggagccctgagcttgttttcctgcaactagatagtcccatatggtggtgatgacagacagtgacagatcatcaggtattaggttctcatgaggaacgtgcaacctagatccctagtatgcacagttcacaatagggttcacgcttctgtgagaatctaatgctgccactgatctgacaggaggcagagctcaggcagtaatgcgaggagtggggagcggctgtaaatacagatgaagctttgcttgctcacctgctgctcacctcctgctgtgtggccccagtttctaacgggccacagaccagtactggcctttggccacgggtttggagaccccttttctaagtgttaagacaagacttggaccttcatggaacctatattctagtaggattaagacaggcattaaacaagtaattacacaataaattacttaagttcaattataatgaaaaatactagattctacaagaaattataaaatctactataaaattctttagtgttgttagcagataatttactcaccatttaaaaattatatcattgattaaatcaattttaaaatgggaagtgactttgagaaacagacttactacaaacagacacataaagaaaaatctggtacatgttaaagagaaatattgctataaaatcagaatacattatatgaagtctacatttgaattatgccatgtgtcaagtttgttaagcatataggtaagatgtaattattattttgctcttgatctacttttattttttatacccttaattctaaacctttggattgtattgaactttaaaatacatatatttgattcatttaattttaaataattgaaattattatcaaaacctcattgctctgcttgaagcagtagctctacttccctatacttcagtttttcatgtgttatagcaagatctgtactagaattagccagttcaacccaaccacatctttctgtttcgtccttgccttgactgttaattagctcagtggatttttatgtcatgaatgcatttgttttctaatacatcttcattttaatgtaagatggttgaaaagaaggaccaagtcctctgagaaccccatagtacaaagtaaaatgcctcacatctgacaaatgctcagtaaacatgagtagtgggaaatcttgattatatgctcattaaaaatatatctatgtatttaaagtagtaagtctggtgttcaaaaggtaaaaccttcaaaattctaacacagttcttgtttggattaactctagtctataatcacaactcttctgtttccttgtctgcactgtgctcacataatggctatgtctcttaccgccaaagcccggctcactgcttacaacggcatcctgtttcttcacctgtttttcttttgcttacctgacaagctcttgcattcataaaagtcgaaaggattccagcttaacgtttcaatcccacaaagttgacttccatagcgtagcctggaacaccttgtctgtgaatagatatggaatcctcaaatggttttgaagccactaccagcaacaggtctgagatcataggacccaagaagaaaattgaggctggggaaccacagagagtctttccacaattcaaagtaataacaaagcagccacaacagcagaggtggggagagatgtaggcatcagattgcctagagctctaacaacctaccctccacatagaagctgctctctgcttcaggcttcagatccttaaatatgggtggggtccttcatttagtgtcaaagaattgattagaaagctcctgcaatgtaagctcattaatgaaaccattttggcaggccagatgatataattagcccaaacaagatatgaaatctacagtgttttgggcaactgttcagtaatttttaattttgtaataaaaaagacaaggaaaggaaacagcaagagaagatgattcatgcttattggtgaaaaagaataagatataaagaaaaagattccaagataacatttgctagatgtggatagtaccttcaggtttccatcatccttctgaagacagtagcatttacaaaaactgtatcatctctacctttacaaaagtaggtgctatgtcaatagtgtgtttataggatgcatggatattcttcaaaccaaagtataatcacaaattctggtctcgtcacagacattcatttaaggaacatctccctcccctgcccccatgctaacctgagctttctggaggatgataaaggcgacctgaataatgaagtacccaagtctcactactgaggcgagtcaggggtaaagagtttagcactgagtggctgaggatacgtatcaagggaaaatgtcatccttgggacttctctttaaataccagaatatgttttgttttgttttgatttgttttcctatcagggatgtgtctttattggcaatccctaatggaaattgctctctaattttcctctagtcttcttatttgtattgtttgtatatgaaaagatgagatgaatagttaagggtactgcacaaatactttgcttggtcctataggctctcaggtttttttgatatcatgtggcatttgtgtcaaattgagttgtgctgtaattttattaacaagcttcacatctcagaatattttacagagatgcacctaacacagttgacatgttgtctattaaaagttacatcatcttaagaagttattagtccttttaaacatcattttcattctaataagctattttttatttctaataagctatttcttatttctaataaactattttttatttctaataagctcgtgtcttgagcagaaacactaatacccaggaaattttctgaggactggctcacttaaaatgaagggaagtcactccacgctctgagttgtcttctctcatcttcttcatgtgaaatcctggacacttgcagattcatgacaattcagagattattaatccaattgcttttaataaagactgtcctgaaagatacacatggtgaaacattctaattgtaaaagattcatagagcaaacaattctgtaacatctatttccatatgatttgagcaatttcacacttgggaatttttttttttttttttagatggagtcttgcactgttgcccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgcccaccttggcctcccaaaatgctgggattacaggcgtgagccaccaccgtacccggcccatacttgggaatttttactacagctgactgaaattttttatttgaatcctattttatatatgaggatactatttcttctttacagcattaaattttctagattaaaaaatactcatttccccccaagattttataaaataatttctggcacttctctaggttttctagctgtatgctattttgagatgacttggagtcaaactgtctgggttgaatcaaggctgtccccaccagttactgtctgtctgaccttgagaagttatttaacctctcagtgtggagatgttcatggtacatatctcatagggtttctgagtggataaaatgttctgatacatgcaaaatagttagaatagtatttgcctggcataccttaagcactcagtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcatatataaatatgtattgtgtatatccaacgtggctaacatgccatgtctctctcttttttatgaatcacccactaacatctccagtgaatcaaatttggaaacaatgggcagtcacaataagatacatgtctgaaaacccaaagttgattttttcatgctttcagtaattacattgaagttgtcccaaaggcagaagaaagaaaaagaaatcaagtctccaaaatttctctatcctttagaaagaaactccaccttaatttttggtgaggagtaacagatctcacttgggtggtagttacattttgtgatgtgagggtgtcagctttttctccaaggatgacctcccaagaagggcagggtcactcacttctgctacacttcccagctgtctcttttggctttgcacattcctgtctcatgactctacagggaaatccatgatgtagattttcctgtattcaagcaggcaaagatacgggtcaaacatttaaggccgttaacaagaagttaaatcagcaacaacatttatatagaggcattaattcagggtgaacgcaaaatgtgttgcagcatcgattctggcatttttctctgctcctaatagctctgagcatttgatctatatgttatatggacctaaatgaagggaaataaacatctggacagattccttccaatcgagtttccttcttaccatttttctgctgtgatagttaaccaaggccatgggcttcgttcacctagaaccagcctaaaattaaggatgctggccagagtacccaagtgtgatgcttgtagcatttaagcatacagataaattctttttgaaaaatttcaaacaagtgtaccatgagcggagtcagagcccctcttgaaagcaggttggtaaatttccagaaccacttagcagttttcataggtggcaaggcattgtattgttatttttattattgttaggagctaacatttgtttccaggaactgggctaaatggttcaaattcattatctcatttaatctttacaatatttctgtgaggtagaaagtattgttatctccattttagagatagcagttatagaagaggcatctggagctaaaacagattaaatgaccttttccctcaggttcagagtaagtgtcatattgcaccccagaataattctgtgctcaccataatgatttacccttctaaaaggtaatataatgcaatttcagaaattaatgattcttaaaaatgtgtaagcatgcagtgagccgagattgcgccactgcactccagcctgggcgacagagcgagactccgtctcaaaaaaaaaaaaaaaaaaaaaaaaaaatgtgtaagcataagaaaaaatagcgaatgtccttttctagcatcacactagattttacgggtgattacaggaagacccttttgagattttcagcaatggacttttcttggatgagacggaagatgctctcagctggtgtgactaaattgtttgcgacttgaggacatgggtcatgccctctgtgtgtaccactcactatatcctcatcacagttcctgcataaagcagagattcagaagggtcagtcgagaacatggatgacaacccaacactgtaacccagcagcttgtgtcttggtgtaacattggtaggttttgtttgcctttacatttttaccataagaggtcaactagagtttctatcttgttacaagttcattacacaggtatcccttattccttcattcaacattgcaaagaaaacatctgtaacatgctttgagtcattaagagacattgcatacagtcaaaaaatagcatgaatttattaaattcagtactttggctgataaattgagaggaaacctttattgcaatttggtggtgatagtggagagtctctttccaaatataagacctagcattaagaagtatttccaagtctcctattttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgcacatgtagttaatggatctccagacaaaggccatttcttccctaaaacaaagccaacaaggcaattgagccaagtaacttcaaactccccagaggggacagcagccattcttaaatccaccatacttttgaatagctatcattggtcattatcttccaaatggctttgtaagtgtctaggcataatgtgattgctttggaaattctccatttttcagggtgctgggaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcaatcattaaaaagtcaggaaacaacaggtgatggagaggatgtggagaaataggaacacttttacactgtcggtgggactgtaaactagttcaacccttgtggaagtcagtgtggcgattcttcagggatctagaactagaaataccatttgacccagccatcccattactgggtatatacccaaaggactataaatcacgctgctataaagacacacgcacacatatgtttattgcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaactggaaatcatcattctcagtaaactatcacaagaacaaaaaaccaaacaccatgtattctcactcataggtggtaattgaacaatgagaacacatgaacacaggaaggggaacatcacactctggggactgttgtggggtggggggaggggggagggatagctttaggagatatacctaatgctaaatggcgagttaatgggtgcagcacaccagcatggcacatggttacatgtgtaactaacctgcacattgtgcacatgtaccctagaacttgaagtataatttaaaaaaaaaaaagtccctttcttctttatctcttcctccctgcccctttcactgttctgcccaacacaaagttcaagtcgtctagagacgaatatggcttttgcttttgtagggactttttcctgagtcccttcctagcagggtacatgcaatataggcctgtgagaataactttctgcggtgacacagaacagtgaaaactgtaagtcagtctatggtgagtgcaatcctacattatttcatgcataaaaaagtcatacatctgtatacatatataacctatttcacagtaacaataaaaacatatttatcgattcatcagaggatagacagatttgtgtgtctatccaaatgtattacactgtgatttttttcttccttgagaaagatttccctgaagacaatatttatggcagggcaggaatttatattacacttgaatatatgttctgacaaagaagcacattgcattttggaattgggtgatattggacattcttcaaaaaatcttctaaagggaaagaatgtttcatctactcatttgttcagatttccctataatttttagccagcagtcctttatggatcagatattgcatcaaaaaagaaggggaaaatattcttgtcatggagacattttcagattaagttgaaaaggtccataatccttacggaaattttttttttaatcatcatcaggctattcttgacagtcagtaaaatatcaggtctttctcatttaactgacagatttcttctttttgctttctttcttccctctctgtatctatatctactctctttccagggctcacggcatatagtaagtattgaaaaaatgaatttaagtctaacttatacatacttgtgaaacctcattccttatgataaagaccttaagcttttctaaatgcagaatcagccactggtcatttttaatggacacgtagtggttgctattttctggagtgcaggattcattagggtcattgctggcatttggctatgttcagttgccccggtgtgctactgaaggcaagtgtccaaacgccaataatgtttggtttctctcgatattccgaggttatatatcaaaagaagccgtgtgtatggcttccagttacccatccagagaattcctgaaaaaagcaaattattcttaagatcccctggaattatgaatctcttggtggagatgcatggtagggaaaagggaaacttgatctggtttattctgaaccctttcttctcatcttatccttctactaagtcacttgaaaactgttaagaaggagaacatataggcattatgaaagaaactatgttgtagcagaattcttcaaggtctcaggatttacccttataaaaactgtacataatctaaagcataatagccaaaacaattcagtatgaatcagacgtacacatacataattgtctcattgagtttcccatctccactaagtcatggtcactgttttgccttggttatggtaactaaaagccaatggagattaacggaaagccccccaggagaaaatactcttttgcggtctttggatgaaggcctgagtatcagcaggactggagttctaaagaaactgctatgcccattgcatgagacacatgaagtaatgaactatagacaagtcatcataccagtatttcagaaagtgaaactgatataagaacacaggccagacaccaactcaaacaaactatggaagcagggagagcaaactgaaatacaaaggcatggccagtagccagagcaggagtgcctcagaaattgatgatagatgaagacaatttatgtagcagttcgtctaatggcagttctgcagggaggcatccttttgaaggtgatggctcaggttggcctacatgttcctgcccaattttaaaggtgtcataagccagtgtaattggggatctgtctggcttctgacttcttgcataactatgttcccacttacattggggtcttggcataatttgtctcctgacaaagagaaaatagaaaatatccaaatattccagccttatagcatagatgggtaaatataagacctttccttttagcattgatgacagtaaacacaattaatagctttctatttgccaggcatgtgacatacgactctgaaatcttgcaacaacccagttagaacgacttactaagacttgaagttaagtttgcctaaatgtatacagcaggtgattaaaatatggatttaactgctgatttgttcatatttaagatccttgacctttccactgttataatagtacatattgatattccactggcgatgagtaagcatgccttaccacttcacaaatagataaggtggcttctaagaaaatctcaaatagaggtggtcaggaagccacaggaccaaccaagaacccagaaacgacagtgcttactagatgctgcttgcattctaccatgtggatacaatgagtaaaacttgggtactaaagtcaaagtgcctgccaccacacctggctaatatttgtatttttagcagagatggggtttcaccatattggccaggctggcctggaactcctgaccttgtgatctgcccacctcggcctcccaaagtgctgggattacagatcccaactggattgggatcttagcacttacttgctgtataacttctccaggttactgatcatctctaagtctttgattcttgttctgtaaaatatgataatagtaggaataataatagtgccttctttagagatagttgtcaagattaaagtgcttagctcagtgcttgacatagggtaaatattcaacctatagtcaatcatcttaagtactcttgtctcaccgaggaaccatcaggaggtgtaggtaatatgcaaccttgaattagatgtaataaaatggaccccacaggaagtatttggggatattttaggcatattttccagtacacatatgcaatattagataatattttccaaaccaatgctatttaacctcaaatccagcacagtgaaaaaacattgaaaggtaaaagaaaaagtcacttcacttccatagttctcagaattaccatgtagatatcaaaaggtctcttccaactctgaaagtctgtgactaattttgttaaacccctactgtgtgcaaagtttgtcactgggacgaataaggttgacactctcagagaagcaatatgtaaaaagacatgtacaattctcttaatttttttttttttttttttttttgagacagagtctcgctctgtcacccaagctggagtgcagtggcatgatctcagctcactgcaaactccacctcccgggttcaagagattctcctgccccagcctcctgagtagctgggagtacaggcacctgccaccacacctggctagtatttgtatttttagtagagacagggtttcaccatattggccaggctggtctcaaactcctgaccttgtaatctgcctgcctcggcctcccaaagtgctgggattacaggcgtgagccaccacgcctggctatgtacaattcttaaaataagctaaagtgataaacttaccctatggctttgtcatagaagggttttaaagacaaaaaaaaaaattgaaaaaaattgaacttctgagaagaatggtgatattatagatatgctatagcctctaaataagaatagtgatgtttaaaggaatataaattaaagagaacactaaagggaaaagagagatggattttaccctctggatctgactttggttttaaattgcataggcaagagattggttagagagatttatttcaacctttagtagtgtattagcagtgtcacagaacaagggatatggttaaaagaaagaaggtgagaaatgcgaacaaacaagatagtgtcttggaatctgatttatttaaatttagattatattgctgttgcattaatctttgtataaatcatagttctaagcacattaaacttacgttgcagtcaatttttaattttgcaaaccttaaccgatgtttattattataagctgtgaacatttttttaatcattgagaaggcccctctcaagtgaaattttggttccaaatggccaaagtaactaatgggcagggaaaaaaatctgcttaaactctcatttcaatcacagttatgtggaaacatcttgaagacaacagtaaaggaaagagaaagaaatcaggtggatggagaagatacactagaggaatgagatctcctacatgagtaaagtgttttctaatgtgtttttcttgaatgatagcatcttgaatttcctacaaagtatggaatagtttacctctgactagcgctgccctacagaacaatgtcaatttattctaagactgcaatgttcagaatgcagatatgatcagttcaacccagatgagacaatcctataaatgtaataatagaaataactatttgaaacttgaaaatcagaagtgttttaactttcttcaaacacttagactataacaacatttttagtctaatgtaattagcgcaattttcagaggatatgtttatatcaagaatattcctgtgggagaaatagaaacttttaaggagaggtttctaggattcttagacaactaaaactttcgtttgactcagaccctgatattacattttcccaggattcctctcacttgtgctgttttcagtgattgctcaggttatttcgaatgatggcatacatatatcttctctgacatgcaaaaatgccagaaccttctttttcctccctctgttcccagaaagaactaagaacggtctagctttgagctaaattgtacagctgactgtttgttttgggaacttccaaatgaacatatttggtgttgcactggtgcatcccaggaacagaactgtctgaccagaagagcaattctgcttctggaaatttctagcacataagaagatagctggagggtatgtttgtctgtatagtttagaggctggctggtgctataaaggaaagtaagaaaaaggcaaagatatccttcagaggattcccccagaagaaagtagcagttatgaagttttattcctgaggtaggacaggcagtcagacccaagaggtctcagtgtctctccctgtgttggatgtaattgcttttcattgtcaatactgaaagaaggcacacaagagacaaatgaaatgtgtgtgtataaacctggctttggttttcagagacagtcttcttacaccttcagatctcctagatgagctgggccttacagaaaatacaagtcttgagctctatttgtttacagttttcaaattctcagcttctgcctgtaagatatctcatgtgattaactgatttttctaatttaagggagttattttctgtggaggaagaggctataaagtcacatttttatcttattttcttttttttttctctgatatttcttctctgttttccacattccttgtcactgtcaaaactggtaattaatcaagagttagtcatggatggctccttttccctccccttcttatccttcattttcctgcctgagtgataacgaatgatgtctcttgtcctgtacccctggcttcctctcctcagagcattcaagccagaccccatgacaagatgctcccagtgaagggagaaaactgggaatgacaaatgtgagtctgggaacccaggcatcaaggggtggacttcctgatctctaccacttgccatcatctatctctccatgtcaggaggcctttgggaaaagcagaaacaaaagagaaaggaaaagttctcatcccagcattttagcatcatgagaaacctggaagtacctttgcaatagcactaaaatatgatgagtcttgagtctttcccaaggttttgatacccaccagcccacgagtatacatgtaggcatacttttactctctactttctccagcttaatgtttttccaagtgtctggaggaaaataagagcaaacatctttgtaaaattggacacatctcttctttcattatatgattggtttatgtgtctgaacaccttaggactcagtctttactcttatttaactgaagagattaggggaaatacttcctcacccaccacagagtctgaaattctgctattagagactcatgcctttaggtgaaaatgttgcatctccaagaagacccatgaaaacagaagtgattctaggtagaatgaagatacaatataagctaatcgatgatatcctcctataaattcctttggcagatctatttactatggagatccctagtggagaggatggccttaaggaattgggaaataaaatagttaacttgagataggttgaaagagaaaataattcctgagaaaggaacacaatactgcttgaaaatagtactaatgtatttttacagattagtttttgctggttcctgaaccaaatgactagctgggacttcttattctcagatttgcctcacacccacttaagaaaaataccagattgacatcctcaagttataatctaaaatcccagggagggagcacactagtcaggggtgagattaaatgaggcaaaagtgactgcatcacatttcactgtctatagaggctattggcagatttatgcaggctgagttaagtgaatgacttgatagcctggatcacatctatatgtgtttttcacaggcatcatgtcttagttagttttatgttgccataacagaatgccccagactgggtaactcaaaatgaacagaaatttatttggctcacagttctggaggctgggaagtcttagtgcatgaaactgacatctgacatgggcctttgtgctacatgatcccatggtgaaagttatcacatggcaagagagcatgggagagagccaaactcaattttataaccaactcacttctgtaataatgacactgatccattcatgagaacagagccctcatgacctaatcaccttttaaaggtcccattgttcaacactgttgcattgggaattaactttccaacacatgcactctgggggacacattcgaaccataccaaacatccactctgtagaatgttgcccttaatatgctgtgattgatatagatagatagatatagatatagatttttttttccttttcagtgtgttttagtatattagttgggtctcatttgcttgcttaaactgttgtatgaaaaaaaagaaatgtgctgcaaagatacagaggtatattgtgcagctcaaattaggtcaggaatgttattaatttaattagttatccatgcaatatgctgcataacaaacaaccacaatatctccagcagcacaggacaataaacacttatttcttatggagctgtgggttgcttgagggtcagctattgcagcttgagactggctaaatggctccactaatctcagctgggctcactcaagggtctgggggtcagttgaggttcaggttatataggctttgctcaggtgggctaggtcagctctattacacatctcttatcctatttctgggtccagcctgctagcttgggcaaattcttttctgtttctacaggttaattttggctggttactggaccaaatgtctctgtggaaattctccttctcaggtttgccttatatccacttaagaaaaatgccagattgacatcctcaagtcccagtctaaaaacttgggtaggtgcatggtagtcaggggatgaggtcaaattaggcaaatgtgacttcatagccctgctgtaaccagctggaaaataagagaatgaacagacaaaaatagacttgtaccacattaatgacatactgattatttgaattagttaattttgctaggagtagagataataagagtgtggttctcagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactgatcagggcagtggttgcggaaggttggggtggcaaacaacaaagatgtttcccgcaaggaatttgagtcttcctttcatgaaagacttctttgtagcatgcgatgctatttgatagcattttacccactgtaggacagctttcaaaattgtagtcaatcctctcaaaccctgccattgctttttcaactaagtttatgtaatattctaaatcatttgttgtgatttcaacaatgttcacaacatcttcaccaggagtagattccatctgaagaaactactctttgctcatctataagaagcagctcctcatctgtttaagttttattatgagattgcagtaattcagtcccagtcccatcttcaggttccacttctgattccactctgccacacatttctctgtgagtctgttaaaatatggataatccaaataacttctttctaatgtgatttatatgaaatggaagcatgttctccttcccccttatgtgctcttgttttgaattgcaaatattcagttttgcatatatttaaaagttattttgacagtatgtaatgtagatttaaaacattctgaagttggctgttttcccttgatcaattcttcttttagaagaaacactgtaaataaaccaacaagtgtcagagcatacagtatagggaacagccaaggacaatctgttatgatattctgtgtattaaaaaccagtttgtttataccactaggagaatttcattttttagtatttggatttgatggatttagtgagaacgatatgatttgcttcattagacagctatgccacagctgaacgatgtgcattactcttaatgctaaagggagataaatgtaatgatagaaaaagttaagggaaccaaagaggcaatattcctagaataagcagatgaaaatttaactatgatgcacagaagttaaatgtcagtaattccattcaactaggtcagtggaattggggcaggaactttcttcattgtagcagtgaagctgttagctggtttacttagaaaccttgaatctgaggaatcatctccagagaacacctgatataagctacagttttcttgactcatattccaaaatggggattgaactgtgagaaagactacaagtaatttctgagttactgaacttagaaaaagcaaaactggccaggtgcggtggctcacgcctgtaatccagcactttgggaggccgagaaaggcggatcacgaagtcaggagatggagaccatcctggctaacatggtgaaaccctctctctactaaaaatacaaaaaaattatctgggcttggtgacatgcgcctgtagtcccagctactctagagactgaggcaggagaatcgcttgaaccctggaggcagaggttgcggtgagccaagatggcgccactgcgctccagcctgggcgacagtgagactgcgtctaaaaaaaaaaaaaagcaaaaccttgggacttctttctttcccttcttattttcacctttccttctcttccttcttctctttctacttcccttcttgtctctctatttttaccttattcatttcctctcgtgcctttccattttttatatcaggaattaaataccctctagagtgaaacgatgaataaaatctactagtcctgtgagaaggacaaaattaaatgtgttgggttgtgtttgtgattgtgctgatgacagcaaaagaagccacactgaggattgaagatgagaaaaaacaaactacaatgttcactaacgtaatttttaagggagaagatataaagattaccagagttcacactttcaaattgtttgcaatcaattgaaagtcgaaaaaagttatatgttgaacaacatatgagaaaaaagcaagtgaccatttaaggtgatatgtgttaagagcaaatcaactgatagagatagaaatgtggatgaggaagaccaccactattccctggggtagtcaaaggaaagttggcctggtactggattttggataacactgaataagattcaaacagacaaaccatggttggggcccagcttgagcaaaggatcagaagcagcagtattccagacatgtgagaatataaatttggttcaagtagaaaggtttcaaatggcagatgactgtggaaaaataatttggtgaaaacttataaaaggcccggaatgctgagatagaaccttgggttctattcagtatatattttgagaaccactgatggtcactatggagaagaaagacgtgtgctatataatagaacaagaattgagaggtcattgactgggggagtttcctagacccagagaagggtaagaagggatacattttgaaggctggtacataaagagaattaagatatcaatgagacatattttaaaagccaagagaaggagaggaaagtggtcattttcagttctgaaggtgagagttttgaggtttggatgactatgaaataacccagtgagaatacccatttatcagtgggaaatcctgaactagagtttgagagagtctgctaagctaaagttgtggatttgcacgttagcctcctgaagaggatggttgaattcataaatatggatgatactctacagaaaagaagtttgcttagaggatttggcatatccatgatgagagtataccggggaagcaaggaaacactgaagagagaaggggtggtcagaagaactgtagaagtggggcaatatgtggaatagtgagggtctcagaacagacagaggacctgggccttgaaggccagctgcgtcatctggagatgaagatggaaggaaatggggatcattgaggatgaagaagaaaaggagccctaaaggtctcttacagtcatcactttgtccgtagaaacacatctctgggaaggaatgagttaggtttttcttattctttcttcattaataaaaatagaaaaacaggtggtgaaacaaattggaaaacaatgtacacacaactaatactcttgaagaaagagatttcacactgtgtcctgctaacctgttctgatattcaatggcacttgttacccaggagttcttttttaaatcactatctgaaatccctattgctctcctgtgagctgtattttttttttttttttttttttttttttggctttcctctgtttatcctcaggggacagaaagaacatatggcaactatctctcaagtaataatccttcaattttggaaatacgtattatataagatttttcctctctagccttttattctttgagctaaataatactaagaaatttaggctttctttatggtcatttcttcccaggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggtattaattcatcaaccagtatttgttgcaggccaactaagagtttggcactgtgttccaaggggaagttaagtaagcacaaaaatcacaaactattaaagttgataaagctgctgatttaagccaaaatagtaattctcttgacaacataagagtgaatgtttacatagcattgaccttttgccaggcactgttcaagcactttctacgtcactacatatttcttttaatttttacaacaactcattaaacaggtactattactatccttattgtacaggcgaggaagcacgtgagaattggctaaagccatatagttagtaagccatagagttaggatttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgttctccctgaagaggttttcaggaggctcagttttatacatttccttgggggaaaaatgtgtgtaggaagagttggggggtaggcagaagaatgattgctctcatattgtctttgttccatacctgagaaaataaggattattagtgtgaagtataataggcatatccttgttttgtgggagaatatacaccttttttaaggtattaagattatttttttctgtaagttattgggggtacaggtggcattcggttacatgagtaagttctttagttgtggtttgtgagattttggtgcacccattccccaagcagtatacactgtaccatatttgtagtcttttatccctcaccctcctacgactcttcccccaaagtccccaaagcccactgtgtcactgtaatacctttgcgtcctcatagcttagttcccacatatcagtgagaacatacgatgtttggttttccaacctgagttacgtcatttagaataatagtctccaaactcatccaggtcacttcaaatgctgtgaattcattcctttttatggctgagtagtattccatcatatatatataccacagtttctttatccactcattgattaatgggcatttgggttggttccacaatttttgcaattgtgagttgtactgctataaacatgtgtgtgcaagaatctttttcatataatgacttcttttgctccgggtagatacccagtagtggcattgctgggtcaaaatgttgttctacttttaattctttaaggaatctccacactagtatacattccctccagcagtgtagaacttccccctgttcaccgcatccatgccaacatctactgttttttgattttttgattatggccattctggtgtccattatcttttaccagaaaactcctcctgttgaaatggaatctttcttcccatacctttcctttattggtctaatttcactgcctggaggaagatggagattattttctacagagcagactctggatctgaagacagccttcaaactcctccagaaattgtttcttcaggattaatattctctccttaaattgctacatatgacatttttcatttgtttagctttgcaaaacttgcctattcaaaaaaggatattagatagttcacagagatatacacaacagacaagcaagataatatatatacctccaggttttgtggcatcaatagatttgataaacatactttgtgtcttcattagagcagtagataaatgaattagggctgtacagagtataaatccctgcggcacacccctacatatgccccatctagaatttctcaaatatccaggccacatctttctgtcctagttacaatgttaattgccaattagcatgtttatgtcaagatttcctgtgatagcatttttctctgggatctaataacccagtaaccttggacaccagcattatatagtgatatggaggtggattttggattcaaaatgtgtgctaaagctttgcaataatagacaacttaatttctgagcttcagtctccttgtctagcagagataacaacaggtaccgtgcaccttcttaaggctagttgtatggattaaatactatatacatgtaaaattattagcagatagtaggtgcttaattataattgtagacatttgtcaagaatgactcatttggccaatggagtgttggcaaatgtttacttaataattaattggctttctgagagaaaaagctctggtttggagcatttgatgatttccctggtataaacactcccaccaaagcttttgagctaccatcatggcatcatgaaaggcagagttgggtagcgatatatgcagtcaaatggctcttgggagacagtgccagccagtgccaacatccccctgtgtgtggcccatgctacactcatactcccactcacaagtaagattgcagcattaatatgtgagtaaaaagatacaaagaaaaaagatttccattacaaagagctcccgtcaggtgctgatagtgcttgaaaaagagatggttattttagttacatttataattgtgaagcttcttctgcttgctctggtatatggaagtgccagttattctttccaaatgtgcttggttttgtctttctttacctctttctccctcaccctccctcttccaacaaatgcctcatatggtaacagttaccaagcaaagtaagggattttatgaaaaattccaaggtttgagtaaaaaaatgaacaccaaaatacccattttattagtataggtagcatccagttaagagttgggtataaaaagaaacatttgcctacccaaagaaagcagcatcagaatcttggcataagaaaaatagcattgtttagtatttgggtgtttacatattccttgtgagggtgaatgtctgaatatgctcattttcatattttaagtcatcatcaattaaacatttgtgggtgtatttcttgtgggctgactccagtggctgtcagtgaaaccaagcagctgttgggtagatatggaacaaaaacaccctgaatgttacactcctgattgcttcccctggcacaggtagaggtacttatgcacagggaaggaaatgaagggcatgcatccaggttcctttctagctgtctccttagaaatcactgctttttggacagtactgaaagtatgacacagctgagacttggtgtatgtacacacacagtatcatatttgattgtgttggttgcttccttctggcaatcctttggcaggtggtatcacattcttccctctaaagagcattaccaactgagatttccctttgtgcttagtaaatatttaggcattgtagattgtgtcagcaatgattccttttatgtttcaaaggctggaaaatttttcttccttgacacttcactgttgttgatttggggaagaggtatgagccaaatggacattggacaaggaattaaaatttataattgccgcgaatagtaacttttccttagctgctgcttcgtacttgaaaatggaatgccctgtagcttgggaaccgaattttatggtggctctgcttttgtgatatttcattcaatccatttaacagttagttgtatttttcaattctaattaacattggtgtttttaatatatatcttaaaactataatttttgagctaagaagccttacaacagatacaccagcaaagatgactagaggtctacaagagtgcatcataagtagagcaatttagatggacttccttctgaactgctgcctaaaaagtttgttactcaatcttatcaccatagttcagcacaaagttaatgaaaatagggctgtataattttgttgtaaaacatcaagtacctgataattatcatcaccatccatctttatccaccatcatcaatcaccattattgtatttttattgcttggattaattcagtcctaatagagcataatggtatggaaattatttaattacattataagtacacactctatcaagtcagaaatcatttagtcctatgacagaaatccagcaacaccacctcctggtaggattagctatatatgcctttaagatatataacttaagcatgcagagggatatatagattgactgacagctgacttttcttctatttctccatgttgctacacttaattttgcctctatttcaaggaacttcaaacacagtgtttaaaagaatcatttaggctctccctgaatatacaaattttggtacctcatcattgtagttctctgataaggctcttggaatccctatttttgacaagcatgccagatgcttctaataacttgtctggaagaacatgcatggaggaacacaccattctgccctcataaaagtcattcatttttctgtctgtttttgttatatcactgcccaaatggaatgtgactatcaatacataataatttcagttactaatatataaattattagcattaatttgcatcaagttatactcatcattggtaattaataatgatgatgaatgatagcagatgtatatatggtgcctactatgccagacattcttaaaggatttgcacgtattaatccttacaagggccttcggaggcaggtaatattatatccccattctctagaggagaaaactcagctgaaggaggctggtcactgaatcacagaaggaagagagcaggctgtagaatcagatggcatgggctctatgtctgcctgtgccacttactggctgtgtgtcagtgacaagggtccatcatctcttcttgactataaagaaaaactggggatacagctgctgttaactccagagacaggtggtgagaattccatgagctgaagtatacaagtatttaaaggctagcctgaagagtaggcatgctctagaaatgttaactgttatcaccttttcttgtgacaaccctgcctttccaataccttttctaatgagttattgtcaataacatcccagtgctgctttctgaactgtgactatctttagctagtaaggagtgtttggtgtctcttttttagaatttttcttttctttttgaacattgaagagcgttcaatttttaattaatcttaataggcacacataccaatattaggcataattaataaccttattatctcattagaaaggcagaacacaatgcacataaccaggaaactaacgtacaagtcttagtgttcattactgctatgatattcattcacatgtttagtagaaaagaaaaaaaacaaaaacattgagccccttttcctaccggatcaagttacagatgttagcctgttcacaaactttcccacatccaggggcgatgtcccccagcacaccatccctccccagctgcttcctggccctcttgcctctgaggcatgctcacaaaaacctgtgagttttgaaagtattttcacctgccagcatcaatgagaaatcttctgcaagtcccctccccatgttcatttctgtcagttccttgggttacggttctcagtacataagtgtcattagcttcacctgggattttttaataaacgcaaattcctgaatactaaattcggattcagtaggtctgcaatggatctcaggaatctgagaacccccaccccgccccaagcgaacatgacacttctcttcgaaaaacactagcttcaattgtagagaaaaccaaaagtgcacatgaatggaaatctgggacatagtaagacaaaagagactgaagtaggaatagcaagcatttcaaaggaaaatgaggctgtcccttctgaggatttcatattaacaactggtgcaaggaaagggaatttgcagcagagttcagaataggggcagtgaggaagtggagttgaatctgagaacatgaataaggaaaccactctgaagatgagcatgtggcataagggaaattgccaccggaatgtaccctctctacttccctaactcctctctttacttctttggcccgttctttctgccacaacctaccactaaagatcctgctttgaatgaaccaaggtcccaggggattgttgcataggcataagggttgttcttggaagcctctgggtttgttgatacagaggatccctatggctccttgatgataattcagttgtgaaggtatagtattgagaaactggtctaaagtttttatggtatatatattttaaattttatttaataaatatataaaaagcactgttctatgtgttttaaaaatactaacacattgaatcttcttaagtactttgtggagtaggtaacgttattattccaatattacagatgaggaaactaagaagttaagtaacttgcccagagggtataaagaggaagggacaaggtgattgttccatactttaaaggaaccagattatcatatttgtagaaagaaagactacattttgagtctatcccaaagagtgttatttgaagtaattagactgtgtagctctgaaagaattggaacccgcaattcaaaacaatttaaactgttctggagacaaagctaactctctggtggggtttctttcttctgatgataaatttgggggtcacttaatccaggacagttcctgcatttatggaaaatgagcatatcgaggtaggattaaagaagtgaattcattcattaggctctatgccatcatggttcatttttttctaaagctgagccaagaacatctgtaccccaattttttattttcttggccaaaaggggacaaataacatctcacactaagaacattaaaatatttaccaaaggtcttcttttagcaaagaatatttcttcattgcaatgcctctgaacatcttcctgaatcaattaatattcatctaaacttttattttctatgactaagtaacagtaatattcataatagcaactgacattcagtgagctcttattctgtggtcactgtttcaggtgttttacctatattctattgtatgaaatagcacaacttactctgattaactcaattttattggatataacagttatttttcaatttctattatgacaaaaaatgttttattaatcatatctatagctaaactatgtaaaaatgtttgtaattatatccttagaatcaattttcagaagcagaattgccagtgtaagagtatactttaagaaaaaaattcagcacattttaccagttttcctgccaagaatgttataccaatctatattcccaccaacaatgtagcaagacttttgtgaaaagtttttttgtttttttgttttgagatggagtcttgctctgtcacccaggctggagtgcagtggtgtgatcttgcctcactgcaacctccacctcttgggttcaaacgattctcctgcctcagcctcccgagtagctgggactataggcacgtgccaccacacctggctaattttttgtgtttttagtagagatggggtttcaccatgttagccaggatggtctggatctcctgacctcgtgatctacctgactctgcctcccaaagtgctgggattataggcgtgagccactgcgcccggtgtgaaaagtttttaaagtaatgaattgctagttagcaacctctgagttttttaaggtgttgtctagcagtctttattaaaaaaaaaaaacagaggtccaatcacctatttccttagaagagggaatcaagggtatatttcagtctgtctataatgcactgctatgtaattactagggaaacttctccaaaagtcacaatgggtaaagtgttataaattctgagtcataagtaaagtttctactatgtgagagactctcattccctgttgtcactgagatcattaaggtctcagttcacatgttacctttgagagaagtttttcctattatcttatctaaaatagtcttcccaaggtctattccattactctgtcttgttttcatagcacttactaattatctttgtttattactttattgcttgtctccccattataacgtatgcttctgggagtcaggagctctttcttataccagcgattttatcacaagacctaaaagagtgcttggcacatgaaagatgtctatatatgatgaatcagtgaatgagtgatgaatgaataaatattggtcctcttaaatcccaaagtcctctgtttactatttatgcacagctattagtctgtagtacaacactgttaagagacaaaatatgcatatggggcaaagcaatatttgtaactctaaggtactcaaccttgtagatgaagataagtgaggaagaaccagttattagagtatcaatggcattggtcatttggttataagcgtaagtgaatttccccttgaatttaccctgtgagttgctatttaatggtgttggacagttacagataagtttggtagaacttttctctttgtttccttaagggttttgcctttgggtaaccaccttaatttcttcagtccctgtcttccatggataaagtcttagcagagctattaaagatcctaatgtcaacttctcttaagattatattgtccattaatgggtgttctgagagatgttattttgagatcaagtgctaaagatttacaatacacactttaactgggagaatatgcttgtttcactaggacagatatgtttctctatggtatccccagcacttacagtaactggcacgtaggaagcattaagaaaatgttgaataaatgaacaagataatcaaattctgtcttgtgaagaaacccatttgggatctattatatgttctgggtaattcctctgagcatcagcgaggatctgtgcaactaacactctggtttatatctaatttgaactgctgattgtgggcagtagaaattatttcagtagaaacttagctggcttgaatttatgagatattattagtctcattaagaaaaatgtctaccgacttctttaggaagctcatgtcttcagaaagtttctttgagatttcatatagaattccttggttttaataaacgttcctgacttctgcatatttgctattgatgcaacaatgatgcttggatcaaagttactttgtcactttctaattcatttattttagattactcagctagtagaaaacaatagagtcactttgttgctgtaaagtctcttcgtagtatttggtgggattgtgctattcttcagtgggctggtaatccctataaagcttagagaaacacagggctctttaaacgatcctttttctcttttctgttttaaatttcatcacttggttatttttgccacctgcttggattgcctccttacccaaatctaaaattcctacagtaaaataaatagaaaatgtggtcgctactctccttcaaaataatattttcatttctttggacaagtatgttaatttcttcatatgcagttgtcaatggtccaggtttcggaaccaaatagcctaaatttgtgtctggaccccactacctgctattattgactttgggcaaactagttaacctttctgtgcctcagttttctcatctttaaaatggggctattaagagtacttctctgtattgtcattgtgaattatgaatcaatacataaaatgagtttagaagaatgactggcacttcacaagtgctcaatgttaaattgtttttattgggaagaaatgaaaatacttccttgcttaatgttggagaaaagaatcactaacccatcgcatctctaagatgatgatgataattgcagttgccatttattacatccctactgtgtactaggcactgaattcaatgctttgtccaccttatgtaagtgaaatctcacagcacagtgaagtattattattattccatgttaccaatgaggaaacaggagaccctaaaaactgagttctttctctaaggttaaacagctcataagggatggagttcagatgtgaatccagttctatctgattttaaatcctgttctcttaattgttatgtcatgtcatctctacagtcttcaataattgagacttaatgttctttgattactaacatccagtggctattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggacttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatcattgtgtttgggctgcggctttagttgccaaagtgcagtttttactgttggcatttccaccacctgctatgggcaataaccatcgaaaggacaaatccccttgtctgtgatttttctttctaggcttctttggagaaagactgtgaaatgatttattcctctgtacatatgaagctatagtgtattctccactgcatagttttggcctctgatactctctgttcttaggttaatccattaacttgcctgggggaaaagggacaggaaagatggatgaaggtgttatgaaaacagagatgagaaggatcttaaaaaatcccaaccactgccttttcttccctgttcccatctgctcctgagaagtccttcagaggatgccaggcctgttaatacctatactttatacctgttgttttaaatgaggcagttcttcctcactatatggatataataaacagttaagctgtcttcctctatgcccctcaaaaggagacaaacacacaagccctacacaaatggtatcgtgcccaaatgagtgttggaaatgctggataaaacaaaggtaagtaggtcttttcattgcaggccttctcagagccttaaaaaaaaatcctcactcatattttgaatctctaggagagacatatagtatacaacattctccaaatttgtttgaccttggaatgcttttttttttttagaagcaacttgagggacaaaagttctgtagaacacgctttggagagtattgggatagattactttcattgcatttttgcaatttggtttataaacttaccttggagattgggcaaattggctggttagtttagatacaatatatttttttcgggttgcaattgtatttttacagtagctagcagaagctgtggttctgaaaagatactataagaacattatcttgtgttctagaaaatagaaaatactctattttcttccccacctccatttttcccctgtctttagaaaaattaaagtatacttaagaagaggaaacaaagtgagtggtaaaggtgtatgcctctatagatggacaggtgtgttagttacattatatccaagtaatgtgtaagtgggccttattaatgagatcctaagaaactataaaaaatgaacataccccagatttctctttgtgtacactttgaaagtgtttttccatttctattaaaaagtttaatttgtcatgctcatgaaatcaacataaatttatggaggcagaacataatacagtaaaaagacaatgtgatccttttcatgtggcatttttaatacattgtatcacaaattacttcaaagaaacaattaaaagaacaaggaagaacttaggaggttcttaaaatagtatgtagcacattttagaactcaagtgacagagctttcctgatgggcccaagtcctgtctcctctcaccctttttttttgggggggggtggcgggaacaaaacaataaacacctttattacatgggtgaagacaaaacgaggatttatttgcctttccgggccttgatcttcctaagatagaactccaactctttgccctctagcacatagccatctgctcggccacatccacacagttctctcactctttcaaaatgtcagcaccagttccagaaggagggactggcccttgtgatggccataatgtaaagtgttcacacgaccaggtagcatttccattcttagaaagctacgcttcttagaaagctacgctacttgattctaagagatcagtcatacagacgtgtttttattcctttcagaggcaattcatttcatgaaaaaatgctgaaatgaaaacactttatagttaagcttggtgtagtcataaccacacatagctgtgttctgtcataatttgtaaattgagctctgtcataatatctatttttcaggaggctctcagttaaattttcttaaaaagtctttctgattatgaaagtaatgcatgcattgccctgtggcatattacatattactctctcatagaatatatagagagaaggtggcagtgaggacaattctgtggtcacctggaaggttttcctctggcacaggaaagacagctgtcctatttctagttgataaagtgcctagactgtgcattagaggccaaacattgaaggaagtcaaattgcctttttgttgattctaaagtggtctttgtatcagaaagtagaatctgaagaaatatgctgcaagccaggatgattatagttaacagtaatgtattatgtagtttcaaatagctagaaggaggatgttgaatgttcccaacacaaagaaatgataaatatttgagatgatagataggccaattactctgatctggtcactctatattatatgtatcagaacatcactatgtgcctgatagattatgtataatcatttgtcaattaaaacaaattagaaaacaacttacttgtctttttgctaaatctggatgtggatccagctgaatataatttcttcctagttctatgaataggatataggtcttggtttccatggtgttgtgtgacttatacttttgcttatctttgtcagtacttttgtgggaagaagataggggctctatcagaggttgttagcttggtgatgttttcacccacaaattcttcatttgttcttagaagttttctcatttctttgaactttccattaacattcaatctttcacttatatgaaaaatattttccttcctcctctttttcctcttccgtactttctccaaattcaggaggcagataatggtaattgaaagttctagggacacactgtgagctcaaggtccagaaaggttagggaaagtctttattttgaactgtaggtatgttttaattccttctggagactagcactcctcagggatgctgagactggcactggtgctaccggatattaaacagaatggatttaaagtattctcctgtattaagaagattattttcaaaagaaagctctattttgtagttattgtcactttcctaaagatataactttcctggagctgtggatcgccacaatattgatggcccatcccagcactatttaaaggcagggctttgtcatattttttataatatttgcagcttggtcaaataatatttattaaatgattaaataaattcaacagcacttagaaacaatagaggcagaaaatgaagttgtggagttggggtgtgtgtgtgtatatatatatagaattagtacattttcacactgctgatacaactgagactgggcaatttgcaaaagaaagaagtttaatgtactcacaatttcatgtggctggggaagcctcacaatcatgatggagggtgaaaagcacgtctcacatggcagcagacaagagaatgagagccaagcaaaagtggtctcctcttataaaaccatcagatctcatgagacttattcactaccatgagaacagtatgggggaaactgcccccattattcagttatctcccactgagtccctcccgcaacatgagggaattatgggaactacaattcgagatgagatttgggtggggacatagacaaaccatatcatacatatacataggtcagattggtaaaagttatagaagcaaatgttagaaaactattttgtaaagttggaaagtagaaacaataaaaaaacacaattcaaagagataagcattttcactggtgtttttttctggtgtgattcttccagagattattctggttatccattgctgtgtcacagaccactccaaatttagtggattaaaaatgataaatattttatgatgtcatagattctgtgggccagaaatttggacagggcacagtgaagatggtgagaacagtttgtctctgttccctgatgtctttgatctcaactgggaagaactgaggagctagaagtgactggcatggctgagacctagaattacctggaggcttctttattcacgtgtctgtgtctgagcctggaatgggatgatttgaaggctgaagttagctgagatggtgtggcttttccatgtggctcaggcttttcatgcatggtggctgcgcttctgagagagaagtcctgagaggaagtatctggaaagggagccttccaagagaaccaggtggaagctgcattgccttttctgacctatcctctggaggcacacagttacatttccaccacatttcattggttacatgtgaatcagaccaaacagattcaaggggagaaagaatgagcctcacttctttgcgcaggagagtcaaggtcacattgcaaaagagcgtgttggatggaagatgttacatctgattttgaaaaatatacttctctacaatattgtttggtcatcttataaaagtaaaaaatagtgtacctttataatatttcattgagaagtgtattaggcactttatcttgctaatgtaagatggttcactttaaagtgctctgtgtttgaaacattgtctttcttcacctttctaaagaacgctctaagatgatatatggcaaccaatcaatattacttttttcatttgtgtagcttatttaactacaactatttaataaatattatagggacattgtgttattccattttgtgaccctataaaggaacacctgaggctcgataatttataaagaaaagaggtttaggccaggcacagtggctcacgcctgtaatcccagcactttgggaggctgaggtgggtggatcacaaggtcagcagatcaaggccagcctggctaacatggtgaaaccctgtctctactaaaagtacaaaaaaattagccaggcgtggtggcacatgcctgtagtcccagctacccgggaggctgaggctggaggatcgcttgaaaccaggaggcagaggttgcagtgagctgagatcacaccactgcattccagtctgggtgacagagcaagactctgtctcaaaaaaaagaaagaaagaaagaaagaaagaaaagaggtttaatagccaaagttctataggctgtataggaagcatagtgttagcatctgcttagcttctggtgaggtctcagggaggttttactcatggtggaaggcgaagcaggaacagcacatcacatgacgagagcaggagcaagaggagtagtggggtgccacactctcaaacaaccagatctcatgaatttgcagagagaactcactcattactaagagcagggcaccaagccattcatgagggatccatccccatgacccggacacctcccaccaggccccatctccaacataatggattacatttcaacatgagatttgaagggaacaaaacatccaaaccatatcaaatatcatagaagaaaaaataaacatatgggaacatataagtgagaaaataagtttgtgaattatcaaaaagtggaaatagtaatatctaggcaggttagcatacataagtgatgttctagtggttctcaatctttgtggcagaatataatcatctacagaattcaaatcaaaacaaaacaaaaaaaactctggtaccctgctccctcccccagaaacactgatttaactggtctaaggtatagaccaggcatcaatatttaaaagttccctaggtgattgtaatgtgcagccaatcttgagaaccattgctttaaacagtttgtaaaatgtacgaaacagggaaagatgtttaattacaatgtttagttacatgactgaaattttatcaataagatctaaattctaatctaaacagaaattcatttgcctcttcattcttcaacagattagttcccagaggacactgttggattcatatctgacacgtaaataaagcccacacaccaatatccaaagcagaaagctgaaagggacctgtttccttgataatatcattgaaccattgaaatattgaccccataattgttccaattttgacttctaagaatgtagaatatttgtattttgtttcaactagatgttggaaaattctatagtttgcacccgaaagcgtttgaaacattcctttgtataaacacattttcttgattgtgtggtcaatctgctggacagatccactatgaattcagacagatctgggtttgaatcctggctctgctaccgtttaatgactttaacaatcttatttcatcatgcctccaaaaactgggagaaaatagaatacctgtttcagaaaatgattataggaattaaaagcatccattcttttattcaggaaacctttgagcacatgagtattccaagattgtattctgtacttggagtatataggaatgaacaagacagccacacttagcagaatgggagagggaggcaataagaaagttaaagaagagatgacaatgtcggtttctgatagaagctgggataaaaaaaggaggtagcaaaaaagtgtgaataggacaagtctgagactcaaatgataaaaggtagctctgcaaggaccagacaagcacatctaagtcagagaattgttaatacaaaagagtcttatggcaaaaataagattggtttatttgagaacaacaacaaaaaaggtcagagagcctggatctaatcagtaatgcagtggagagtgagaaaagtaagattggacgggtaaacagacgactgattaggtaagccaggaagaggagttgggatttattataaatctcatgatcagcatttataaaactttaagcaaggtgctaaattatctaattttatatataaaggggtaagagtgaagggggaaacctggttagcaaggtcttgtaatagtcccagtgagatatgatggtgccttgttttagggtggtgctggtggaagtgaaaaaatatatgtttaattttgctgtgaacccaaaactgctctaaaaaataaggtctattttttaaaagtatataaatgttagtaaaacacatagatttacatggtgggcactcagtttattagagatagggtctcactctgtgccccacgctggaatgcagttggcatgatcatagctcactgtaatctcgaactcctgcactcaaacaatcctcctgcctcagcctcctgaggagctaagactataggcatcaaatgcccagctaattttatttattatttatttatttttttgtagagacagggtcttgctatgttgcccaggctggtctcaactcctggcctcaagcagcccttcttccttggcctcccaaagtgttgggattacaggtgtcaaccaccatgcctggccagtaaatgctattttattcataatgttatcattaccattagtacaatgtggaagcaagatctggctctgtcattagcattgctttggtggaaagatttactaaataaagcagagagacttttccaaattgtatttattatctttaaaggctttcccctgaaggtacactgggatactaagaagacctgaatagcttaagatctctacaaaaggattccacataccggtttgggacttctaagggaaaatgcaaagattcacaacttttaatagacagtgatttttgtttctatatctgacggtcatataattatattttagcatcccaacacagttttgccataatggtgtgactctatgattgtgttgtattatgtaccacttcaacccaaattagtttaatgatgctatagaggcagagttgttttcccatcaaaatgggaacaagtatgcaaaagcaagataaacactatctttcagagtgatacattcaagcagcattggttttaagattaagcaaattcccactgccttgctttattagtatacttatgagaagctactttataggtcatataactgaagtgagtttataattatggcaatgggtctacattggaatgtagtttatagttactagctcaaatatctctgcctttcacgttatgttggaaaactgcatgctatctttatttcttagtttcacatctgtaaactgagattaagatctgcttttctgtttaaagactattgcctacatcagagaaatcatccttcagcacttgaaagactttgaaaacagaggcttcctaggcagataatattttgtttactatggttggttttcttttttccttttgaatagactttattttgtagagaagttttaggttcatagtaaaattgagcagaaagtatagagttctcataaacctcttcctatgccatcacacatgatagcttcccccatcaggagcattccatgcctgagtggtacatttcttacaattgatgaaacagtattgacacgtcatcacccaaagtacatagtttacactaggattcactcttggtgttgtacattatcttcatgtgtcaccatcataatatcctacagaatagtttcattgccctaaaagttctctgtgctgtgcttcctcattccctcctaaccactgtcaagtaatctttttactgtccccatagttttgcattttctagaatgtcatatagttagaatcatatggtatgtagcttttcagattggcttcttttacttagtaacatgcatttaagtgtcttccatatctttttttaatatatacatatatattttttattatactttaagttctgggatacatgtgcagaacgtgcaggtttgttacataggtatacacgtgccatggtggtttgctgcacccatcaacccgtcacctacattaggtatttctcctaatgctatccctcccctagcccccattccccaacaggccccggtgtgtgatgttcccctccctgtgtccatgtgttttcattgttcacctcccacttacaagtgagaacatgcagtgtttggttttctgttcctgtattagtttgctgagaatgatggtttccagcttcatccatgtccctgcaaaggacatgaactcatccttttttatggctgcattgtattccatggtgtatatgtgccacattttctttatctagtctatcattgatgggcatttaggttggctccaagtctttgctattgtgaacagtgctgcaataaacatacatgtgcatgtatctttatagtagaatcatttattatcctttgtgtatatatccagtaatgggattgctgggtcaaatggtatttctggttctagatccttgagtaattgctacactgttttcaacaatggttgaacaaatttacactccccccaacagtgtaaaagcgttcctatttcttcacatcctccccagcatctgttgtttcctgactttttaattatcgctattctaactggcgtgagatggtatctcgttgtggttttgatttgcatttctctaatgaccagtgatgatgagcattttttcatgtttgttggccacataaatgtcttcttttgagaagtgtctgctcatatccttcacctactttgtgatggggttgtttgtttttttcttgtaaaatttttaatgttctttgtagattccggatattagccctttatcagatggatagattgcaaaaattttctcccattctgtagattgcctgttcactctcatgatagtttcttttcctgtgcagaagctctttagtttaattagatcccatttgtcaattttggcttttgttgccattgcttttgatgttttagtcatgaagtctttgcccatgcctatgtcctgaatggtattgcctaagttttcttctagagtttttatggttttaggtcttacgtttaagtctttaatctatcttgagttaatttttgtataaggtgtaaggaaggggtccagtttcagttttctgcgtatggctagccagttttcccaacaccatttgttaaatagggaaatcctttccccattgcttgtttttgtcaggtttgtcaaagatcagatggttttagatgtgtagtgttatttctgaggcctgtgttctgttccattggtctatatatctgttttggtaccagtaccatgctgttttggttactgtagccttgtagtatagtttgaagtcaggtagtgtgatgcccccagctttgttctttttgcttgggattgtcttggctatacgggctcttttttggttccatatgaaatatgaagtagttttttctaattctgtgaagaaattcaatggtagcttgatggggatagcattgaatctataaattactttttatggttcaatagctcatttctcctgactgctgaataatgttcccttgtctggatgtaccacagtttatttattcattcacctgctgaaggacaccttagttggttttaagtttgggcaattatgaataaagctgctatgaacactcatgtgtagatttttgtgtgaatataagtttttagctcctttgggtatataccaaggagcacaactgctggattgtatggtaagtgtatgtttagttttgtaagaaggtgccaaactgtctttcagtgtggctgtaccattttgcattcccacaatctatagatgagactttctgttactcgacatctttaccagcatttaatattgtcagtgttttaaatatggaccatactaattgatgtataatggcatctcattgttgttttaatttgcatttccccagtgacaaatgatacagagaatcttcatatataattattgccatctgtattactttttgggtgaggtgtgtgttcagatctttggccatttttcatctgctgttttcttattgttgaatttcaagagtttttaacatattttggataacagtcctttatcattatgtctttttcaaatatttttcccattatggcttatcttttcattctcttgacagttacatcatgcttttaattgtagaattagacaacaatgaaataaccaaagccttagtaatcttaattagagattatcttctattattttctatttttcttgtttcacctgagttagaaaactgacctgcactgacttcctctttcacaataattccagtgaaatgaaagtgattagaaagtcttagcaaattcaccaaaagttagagccagaagactcacatttcaattctctacctaaagagaaggacaggcagaagccaaatatgtaaagagtttgtcagaagtatgccttggagccatgggcattgttcattactctgctgaatttatcttatggattttcccctccacattaatgtttcaatgatcttggttagattgttgaagtacaggttcctgctaggcatttctaactttttgttttaatattctcttatcctgttcatttactctcatttttccttttagaaatttactgccatcttctcttttagaaattcttttgacaatctgaaggaatgcagttatttatccctatgagcaattaaatacttttaatgggaatgtcatgtttttaaatcacatttcttataagaaaaaaatggtgtttactcaaatgaatgtggtctgatggtgatcctgatctatgagcagtaattgagatcatggaaataaatacaggaaagctggctccctgctcccttcaataaccaaatctatggtttagacattttttagcactttgctccaacctgttacagattatcaacattatatatgatgataataaatcagagcaccactttaaaacacaaaagtggttgcctctcagtgctatggcaaacatagaattttgaactttttgtatgactggtatttttttaagcgactatattttaataacgagctattgcatgtgactttactatgatgctcaaatatgttctatgtatgacggggaggaggaatgatgttaccatatgttggttctgaattcctattttattttattctcaggtggaaaaaagaaagaaaaaaggattcatcagcaatagggcaacttagagcggacacataggtactatggcagtgataagagatgagatagatcatcactatgcccttttcaattcttgggaactgtcttcgttaaacagttttagatgcaagggtaatttttttcctatggtgattgtagaaagaacacccagagattgggactagaagtcaggatgtctttagccttacttggttgtcagctaactgtgctgttttggacaatgcattcttttttggtattctgtttatcccactacaaaatagagatagtgagaattggattaccattgtcaatatgaagcacagatgaggtaagtgtgaatcacttgaggatatataaagtcatttaaaactttaataattataatacgataatatagttgttgatttagtttagtttcttacatatgatattctacatattcttatcacttcacagggaagcattgactggccaaagtaatggtgggtagagggaatcacttaccttagcttaaagagatgccaaaatctaggacctattcagagttatgaattatattttgttgagcagtgttcctccaaaattcatgtccttcctggaacctcagaatgtgaccttatttggaggtcacactggagatgagtgggctcttactccaatctgacttgtatccttataataaaaagggaagagacacagagacagatgcacacacagaggagaacattgtgtgcagacacagacacatgaggaagatggccagtaatgatgaaggcagaaattggaattactccgtaggaaggcaaggatcaccaaggattgctgccaactaccaacagctagaagactatggccatgctcacatcttgatttcagactgtgacccccaaaacagaaatggtgagaaaattaatctattaagtcacccagtttgtggttctttgttacagccgccctaggaaactaatacaggagtcaaggaggctgctgaacccagctggacactgaggggcatccacagaggtcaccaaagtggagtggccagaactagattttggaagccagatatggaggcaggaatccaagaagcagggagcctaatgaggaatagtcataaaaagagctcttggcagccgcctgttccagatgttggtgttgctgccagtttctatctgctcagtacccaaggcactttaatggactgagataggttggacaggttctgtttgaaaaaatcccttacatgcaaagtaagataaaaccaaaagccaaagtatcttgctttaccttgaagaaggaagcaactctccctgatcacagagcttccctacttggccataggatagcctcatgtgcacttagctcaatgttactctgagtttctttctactccgtctttctcgatataatcctaaaagttagggattcccaggaattatcatggaacaactggcttatgtcttagtttcctatcactgctgtaataaatcacggcaacctttgcaatttaaaacaacgtaaaacctattatcttagacttttgcaggtgagaagtccattatgggttgcactagtctaaaactagtgcaacactttttaccccctgaaagacatcaacactttttaccccctgaatctaaaataaaagttgaaattatttttagaaataaaaataaattaaaatgtttcgtaaaccactttggtttcctttctggtgtctctgaggcaaatgttttctgctcatttgagttgttggcagaatttaatttcttgtggttgaaggatggagatctggggtttttttgctggctgaaaactgagggccattggcagcttctagaggctactgtattcctagcccatggtgcctttcttccgtcttcaaagcctgcattcttctgcttctttgtccttttttaaagactcatgtgattagatcaggcccacccagataatccaggattatctccctttcttcaggttggctgctgaacaacctcaattccacctgcaacctaattcccttttaccatgtagcctaacatattcacagctctggggattaggatgtggacgtctttcaggagccatgatccttccttccacacattaactgcagctaagcaacatgactccccatcacgacagagtagaaggagaaactgaactgtgagaggggaaacagctttatcaaaacatagcaaatgtcaattataagcaaaaagagaaagtcaagctgcctataatatgtgcaatatatttattcttttataaacttgctgatatggaaattaaaaattaaatctacttaatggaaaatatttgatataagaacatcagacatatctttgataggcaataaattactttatagaatcgtttagcatcttatcttcagggctattttttggccctaactttgagcacattaattttgagttcctcttgtttctcttctatttgttccctcaaacccaatgtatcagaagttattttaacttaagttttccttgcctaattccatccacttatccccagaattgtttcatctcatgtatttattacactgttcacatatcaccttctattttcatgccccttgtaaacagcctaagaggcacattactggtaaagcctcagggtaaacaggcattgcctcccattttgatttcagctccatttaatgactttttatacccaatgtggacacatactcatttttagttttccaatgcagatttcagctatattttggctttattcctcttttttcatcctttttttctttttttttttttttttttgagacagagtcttgctcttttgctcagtctggagtgcagtgacatgatctcggctcactgcaacctccaactcccaggttcaagcaattctcctttctcaagtaatcctcctgaatagctaggattacaggcatgcaccaccacacccagctaatttttgtatttttagtagaaacgggtttcaccatattggtcaggctgctcttgaactcctgacctcgtgatccgccagcctaggcctcccaaagtcctggaattacaggcgtgagccaccgcgcctggcctacatccattttaaaatgaaaaaatatatatatatgtaatttatttgaagaaagtctattcatttacgtaacacttatcattgagcacttcgtaggtacctggcgttgttctagacactggaaacagaccactgattctgatgctcaagggccctgttggtggcattgcctttggtgcatccttttctttcacctcttatactttcgtgttaatacttccctacatggattgttttcttactttgtcatgtgtacactttccctacatggtgttttcttaccttgtcatgtgtacactttttttaccctttgcattatgaaatttttgtatcctgaatctcgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggtaagtcaggccctgacctcacatgtgacagttaaaaagatgccagtgacatctttccccaaagcaatagaaaggatatttttcaactaacgatttaaataggtcaaagcaaacaggatactcacattaaaggaagaagaaactgcatgttatagaaagacctatgcattcagatacctttgcctgccctgaaattccatttttcaaattcatttgcctgttagctgaggacctttttaatggaactgatgttagtgatctcctagacctctgacagttcttgagagatagcaaaagctttccctgaagtgctagccatgtagcttatccctttaggcactctattgtagaagtctccctgataaagcttcctgtactcaaattcttaggggcagggaggagggataaacaattggaatacttttttgggatattaataattggttatttcaaaatctaaaaaaaaattaaaaataatcatttgaggaactctgttaaattttttaaaaagtgcattaggtttagatgtgatgaagcaacaaatgcaacagatgttgcaatgccaatcagatacttgactaagacaaaagtttaatgccaaactgcttcaccagaaatagcttcctacctgacagaggacactgaattgtgtcaaagtattagaggaggcaattggtaggtaaagataattaaagggacatccaacatgttttgagttctttctccgtatatatggagagagagaaaagggtatatttgtgccttggattcattagtaaaatgcattagctatagctgactgatttgcaactggtgcctgcctgaggtctccaaagagaggagatttacatttaggttttaagcttgggaaactttgaaagttcttataaaaaattagacagtcatttagaaatgtaaatatactgtatttctttctggattacacatttgctgaaattcaccttttagtttttttagaagggagcggtattggcatacgtgttacacttttttgcacatcacttttgaaatgaggttccagatggagtctcagccccagagtgtaacaaagagatcattggttacaacctccttcttacagactaacacactaaaacccagagaggttaaggaagagatttaaaatcacacaaatatttagcagcctggccatccatgactaggacccaagttaatcaaatttccatcatagtctttttttccttcccttcatcagcattatacttgcttgagtaaacatcttaaatatagaatgtttctccttttcattaagaggtcatctaaaatagtatgttctctattctccattaaacatagtttataagatttctttgcctttaaaatcagtttaattagggtaaaatttaatacataattgatcatacatctccaagttgaaacatctattctgtttttaggcttagtttagtcatttcccatttgtttgatttaaagtagggttgaaggggcacacagccccgggaaacttcagtgtaaagtgccatccaactctagccagattcttttatctaatcaccacactccctgaagtctctgataattatcaataaattgggtggtagataaatagcagtgtcatgagagaaggaaaaagctgaaggcacactagcagtgactctttctacctgtcagcaggatggaggagtaaagacagatctgtcctgtttgtcaggagcagaaagtatgctggcgaaaacgaactcctgggaagggaaggtgtcaggaagatgaattaccccaggaagccaggactgctctcccagtggagagcagctcacttggatataatttgccagctgtccgtcttgtcctcgtgcgtctctgtctttttcctcctttgcgctgccagcaacaagcctgtgctgtgtagatctagtgcagccacagaaccttgggactagctgaagggccgctagacctaatggcaggggtaactatttttgcaattgtgaatattcagcatgcacaggcttcctatcagctctcccaggagctctctgagagatggaccctgtgaggaaacatctttaaatgaacaccttagtagagaatgatcctgttaggtgaataaaaggctgattacatacccagaggtgagccataatgaggctcagagtaactaaatgcagcaatctgctgcactttgtatctggacttgagcctgagcatttcaaagtagcatctggaaaagaaaaaggctctggggaaaatcacacagtagacttgaaatatttcatttttttttctccaaagggaacttagggtagatttcttgggtaacggttttgaagaaagaaggcctggtgtgagaggaacatgttgtgttggcatcaccacctcacataaccaaactaacactctcctatcattgttgggtgctgagagagctggtggtccctgcctgtgtctttaaagtgacaagggttgcctagcctgaagattctagcacaacatcagcatcttacctacataaactgaagattcctcaagaatgttgaagcaatagtcattatgtttactacaggagtaagtgaggcatcaatctaccttctaccttgtgagttagccacataaagcagtgccacaggttgaaacaaaccttcttggtctggtttataatttaaattctccatggaagtagctgcagcttggaagctcattccattgaaaagttcactggctttggtgattcacaaaggagcatttcttatttggtgaattagtatcctaattaattcatttcatggagcaagcatctttgtgattctctcttctgctgcctactttctccctggcaggtacaggtaggattctaaagtataaagaggactttcacctggaaaccagaaggttgagttcttaaaggggtcatgatgcttgctagtaatgtgacctcctgctattcaatacttctgagtctccttttactcatctgtaaaatggggagaaaaaaaaactgtcctgccttttacccttttcttagcatacaagagttactgagaatgcttcagaagctattatgaaccactgtagcatcagctatatttatttaaggcacctattttgtatgttaaaatattctagagtatcttataactcttggttaatgaaactaaggactttctcactccttaggtaaaaaagtagtgtttatttcagagcaagatgttcaaaagcaagactaaacaatttgattcctgggatcatgccatcgggctgtcttgactctctctgattgctttcagtatttttattttattgggtagaagaacttggtaaaatgttaccctgaggctaaagagagctctttaaaatgactttagggatctgaatagaccagttgccatttattcccttaatatgattagtttcctaatagtcaaaggctgagatagcatttatttctcctaagtttcagtctaagccaatgtgggtgcctattagtgtcatagtgatgagtggcacagatgagcaaacagataattaaggaaaaccaaatatccttcccatcccccacctcacacccatttagtagttgactttggtgtaaaagtgtcttcctgtttcagtaggataatttggtgctcatctgtcagatagatggaggatggcaatgctaatttgtttctccaggcatacttgcctcagacttaaggactaaggttaccatgtagctcagagctgaaaggtaagagtcagaggcattcaatgattaaatagtcaatatgttctgacttctctgctaatttagcaaaaggaagaacatctcaattttgtcacttattaccagttgtttagcttgtcttagaaacatgccttgatttgaatagataaactacttttaaagcataagtcagcagccttttgttttatgaaatagtagtcctccatttggggcaattaaaatgaccatttctttggaaataaaatgttaaactggtgatggtagggtgaggtctagggggtgataggagagggaagttgagatttcaacagctaagtgcaaaagaaaattttaaaatacttagtattaaaatttttaacttgctactactttattggtctcatataaggacatgaacacctggggaagtaattggaaagggaaggaacataaaaaatattttatattctgtgaggtaaaaactgaggctaaaacataaataatttggcccaggtcatatggcaggagaatattagaatctggatttgatcctgcttttgtctggctgtggctgtgaaaattgagtccatcagttttcatcccatggcatctggaatcattgccccttgccacgtctttgtgtgtgtgcgcgcgcacgtgtgtgtgtgtgtatgtgtgtgtgcgtgctccaagttcatcccgatttctttaatctagccttgttaaaacacattttaaggtcagtttttaaggcacaaaatgtaggatgagtgagttgataggtagatatctattagcttgaaattgtattcaaaacagaacctcattcttaaaagtttaaaaatctatatcaattacccagcctcaaatatagttttcttctctttcaaatgttgtagaaaaatgcttcatattttctggctactgagcttcttaatattagagtaccatctcttcctacaattcggttacaggttgctcacttttagcgacattggctttctagttggagaaattccttagatttcaggtaccacatcagaatttctttcagttagggtgacagatccaatatactacatgtgtgtgaagtatagatgaaggtaatcagatctcatgcttcagggaataaactgattacccgcgatggtcaggaaggaattttcaccattagcatcctgcaaatacacaaacccaagtgcaagaatccaactttcttctatgtaaagttttcttgtagcacctcatcaagtgcagggcataaaatctaaacctatgacataatgtgctatgtataattgttgtcatacatgcatgactgtttattatgcaccaaaataaatactgtagcagttgagacagagtctagttagataactgagatagtgattcattaaatataaactacttaaaatcttttcatgtttcctccaggaatctcaaagtaccttcccaaaatgagctcattaatcctcatgaatattctgtcacataaattctgttacatttctctgaaaacataggttagtcaatcttactaactagtaagttctagcagcaagtcttcacagcactccaacacctttattgccttgaaatctcattagagatttagtttctaacactgttaatctagatggaattctttcatccctagctcattactacatttacccttcaacaaacatgtggtgggagtcaactgtgcgcaacgtgctgaatatgaaaagttaaatggggctcagggttcactgggaaagtgctggtaagttcattcacatgcactccagtacaacttggtatgcccagtgctgcctagcctagcaagaccctctttaatctactgttgccttcttgtacaggtctttatatcatgcgggctttgacacagataaacctactgtaatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaactggttactatttgacttaatgaaaggcctgacatgaaggaaggatgtaaataattttgagagaaaatacttttgaaatgttaaaacatttcttttgagcaatgttatttttattataaaggaaatagcactttcacctctgggagtgaataggggcttctcaatttgatacctaaaggatatttcctctcaagacaaacaaacaaaaatgtgcttactggggctgcaccttcagcccagcattggatatgttaattgctgacatacttgaggtctcactaagagaaaaatatcattagactgctggttcccaaaatacattcccttaaatatcagtcctatggagtggtccttgggaataaaaatcagggaacatattcaatggtaaatatatatatatatatatatatatatatatatatatatatatatataatatttatatatatattatatatgtattatgtagctctttattattattattattatttttgagacagagtctggctctgttgcctaggctggagtgtagtggcatgatctcagcttactgcaacctccacctcctgaggttcaagccattctcccgcctcagcctcccgagtatctgggattacaagcacctgccatcacgcctggctaagttttgtatttttagtagaaacagggtttcaccatgttggccaggatggtctcaaattcctgccctcgagtgatctgccttcgacctcccaacatgctgggattataggtgtaagccagggtagctttttaatactgctccctctctcttaggtattcacagtgcatattagcaaattaaatgttctgtgaagtcttgtattaagtacatcttttaatattttatttaagacttcccaaattcacttgaccattcactttgtaatattccttgacagaatacttgttaatatccagctcctgggaacacaatttgggaaatactacactaggaaaaaaaatctaggttggggaaatctaactaaacaagagtgtttatttacattagtaagttactttgtactttatgtgagtctccttttcaagtgagtttctcaagtgtcttaaaatactattttaaataatttttaaaacattgatatttttttgaaaatacattaagtatgtttttagaacttgaaattgaatgaattcccccttatcccttgtctgccagttctgttagtcttctcttcagtatttgatttatgagagatcaattcatatccaacttttcagagcatgtctcatgtcatgtgaaagacagcatacctatatttgtgtaagaaaggggagaaaacctacttctgagtgtaacataaaaactatgtgacagtcaagtatgataaaaggaaaatactggttatagggtcaagcaacctttatctctttttggcttactgtgagatttgggccaacaagtaacctctctgatcctgcctggataattgaaatgactattacttccctccaccagagagtgaatgatgtgtggattaaagtctgacctttgggcaaatgcctcctagtgacttgaaagaaggtgccctcatttctaacccacaccttacatctgtgtctatgatcccattcacagactggttctgaattaattctgtcagtcttgcattcttgcacttgccttcctgtcacctattcacttgcattctctctctacagttaggacattgtcaacacagattgtgtttgagtaaaaaagttcactcagagaaaaataattatagaaaggaaaagcatagatcaggagacaagtaaagacatacagtgaatctttaatccagagttgatttactcaagccttattgaaagataatcatgaagcaaaatgattaggtatggatgtgtaaatctgtaatgaatgactctgagtaaagattgtactcatcatcactagatttctctcataagtgcattgggttaaaaaaaagaattacctaagatcatttgaaattcagtaataagattctcttcagaagatcttttgattctgtagagaattaacatatctaattattatctgaagaccccaaacaccagatcctccaaaataatgttccttctgacattttcaacttgtataaaatttggttatctggaaatttactgcacataaggtccagcaagagaataattacactttattgatattttctcacaatgccatgagaaaatctggctgaagctgtgaaaaatgagttatatttataaaccagagatgttagctttccaaagtagtttcaaatccagacacccaatacacacacttccactcaccttcacgttctcacaaacttatacaagaaagtactcaatgatgtatttctaggcattaaatatttatatggtgtatataggtaggtatatatatatatgtatgtgtatttatgtgtgtgtatatgtacatatgttcacatacatttatgtatatgtatgtatatatgaatcataatttgctgataagcgttagacactattattataaatttcccttaatacacaaatttctcaatatcttagaagaaaattttcaagtatatgagagctcttctttctatcagcataggtgatagcattaaactgaatattaaccattccccagggtagagaaattatatctcagggtagaaaaatatatattttttgtatggaggttacttcttattgaagtgtgttagatctggccaggcatgctggctcacacctataatgtcagcactttgggaggccgaggtgggaggatcacttgaactcaagagttggagaccagcctgggcaacatagtgagatgctgtctctaaaacaaaaatttttataattagccaggcatggtggcacacgcatgtagttccagcagctagggaggctgaggtgggaggatcactttaacctggggatcaaggctgcagtgaaccagattgtgccagtgcactttagcctgggtgatagagtaagaccctctctaaaaatatatatatttttaaaagtgtgttagatctgcatattataaaatgacatgaattaagattcttcctccgtcatttatttctgttaaaaaaattcactgcttgcaaacatgtacatatatataaaccactgcacactaattatactgtatggtgtcacaagggtgttttttttttttacttgtaatgttttgcctaactttagagaaagcttgaaaagttaattaaaatcaacttatgtctcaacattttgttgcagtagaggaatttggaagaagggaaaagagaatagcaatgaattgattggataagaggcagacacatgtttttaaaaaaggatcagagcttgcccagtttctatttaaagtattgtaaggacctaatagctagctatagtgatacatttaagattaaaatgagcagatttggcggtacaggggagatgatggctagctggggatattagaaacagagctataaaaattcaacacaacctggaaaaatgcaaatgaatacaaccaacagtggggtgcagggttggttgcgggggacaggtggattatcttaggtgatatgctgtggaaggcatggagtttggctgcagggctgggtggtcacctagtaagaggaatgctttggctccttcccttgtctcttggaaatcagaagagacactgggccttttctcctttactccaagaagaaatgctcttttttcatatatctttattgaatacctattatggtccatgtgttaagagatggggaagcaaagagatacaactcatccaccctaccctggagaagcttattgcaaataccgtcaaatgcagtttgaaggaaatagtatgagatttgaattaaggacactaagattttattcatggattaaaatccgtattctgtttcttaatgattttgtgatcttgcacaggtccattaacctctgagcattagttatctgtgaaatgggagtaataattgagtctgcctcatgggaacactgtgatgactaaatgtgaaggtttatgataatgctctgaaaataatcaaaagtgctaaaatgatatggtttttaattatgaggtatttttaaatccaagcttgatagtagagtcagattatatacaaagggatcagagaaatagataagtatgggaggaatgataaatataggaagaacattatatacatcacagatgagttcaggtgcatgggggtcctggacttacaagcgggtgtgcttagtttaatgctctcctatcaccaccttgaaagttttaatattttttaaacaaaaggactcacttttttaatactaggcctcacaaattatgtagttagttctggttgtagacatattgcgtgtataaatacttagattagttacatgcccacaatattaatcattaagttatttgtgtatacatttaacagttacccatctatttatctatccctatagagacatattctcccatgtaggatgtgaggcacttgaggagtgaaacttgcttgaatggatctagggcccaggagagaaggcgaacctgaaaaacagttgttcggtctaatagttatcactagttggaagtcttgtacgttccaaggtcaagcgctgtgatgtgatacattacacacacacacatataatatttatttatatcatggaataaatgtgtaaatattactatattactaatgtatcttaattttcttttttacaaagatcctataatatcagtaggtctagaattaggtcaagaatctgcatttttaaaaaggcattccagcggcttctaaggcaggtggtttctagacaaactttccaaatactgagtgaaaagtttattcatgttgtgtttccattatttatgtgtaatttggagaactgggtgatcttttctccaggagcccctagcaacagatccagagaaagaatgtcatagctagcatttctttgtgttatttgggaccaatttcaaagttactgcaagatgtttgctttgccaagagatatcccatatccagtccaggccctattggatgccaaataactattagtgtacagaagcccccacttttccatgggggaaatgatctaagacccccagtagttgcctttaactgtggatagcaccaaaccctatatatactatgttttttccatacatacatgcgtatatacatagttatgataaggtttaatttgtaaattagtcacagtaagagattaatgacaataactaataataaaatggaaaattatgacagcatgctgtaatacaaacaatgtgaatgtattatagtctccctctcaaaatattttgttgtactgtactcacttatttttggaccatggttgaacaagggtaactgaaactgcagaaagcaaagtcgtggagaagggggaactactgtacataaagaaatagtggataataacaatgagaagatagattggggcctttaattctggataaaggatctgagactcttctcagaaggcaatagggaaccactggtcatacagaattaaataaaggagaaggaaacaaaaggtaaggagatcacttagaggctattacaaaaaaagtagagaagaggtaacaaaggccaaaagtgggcactaagagtaaagattaagaaaaaatatctttaattatggaaaatgtatggagattcctcataaaactaaaaatagaactcccatatgattcagcaatcccactactgggtatatatccccagagcttgaaatcagcgtgtctaaatgatatctgcactctcatgttcattgcagcagtattcacaatagccaagataaagagtcaacctaagtgttcatcagaggataaatggatgaagagaatgtagtaatgtggtatatacacaatcgaatattattcagccttaaacaagaaagaatttctgccatttgcagcagcatggataaacatggaggacattgtgctaagttcagaaataagccagacacagaaagactaaaacagcatagtttcacttatgtggaatccaaaacaatcaaatttatagaggcagagaatagaatagtggttaccagaagtagtgggtagggggaatggagagatgttggtcaaatggtaaaaaattttagttagaaggaattgatgataagtatttaagaaaatggatatattaattagtttgagttaatcattctatactgtacagatataacatcactgtgtaccatacaaatatatatatatgcaattatagtatgcccaaaaataatctctaagtcttctttttaaattttactttcataagaatggtatccatctgattgaagaccatcttctttcttctccatatgcaaatgtattccttatagaaaaatgcactcctgcccccaccccagcaaccatgcttcaggccccaaagaagttttcctccctgttaccttgcaaaggtagcctctcttgggaatcgctcactaattcaccctggaatactcttatgttagtttcccttatggtccctaacagcctttatctgttattcatctcccaggtactcacagcttgctgaaaggctttttctaatcagcattgttttgtcttctttaaaatccttgatcatggccactagcatccttgacagtctctggacacttggtgagaaaagaataaactcaatgcacaccagtgagagatcatgcccttttcttctgacaactttgtggcatctttggctgccctttttatgtgcttgtctttgtgctcccctacatcaatctcataaaacatcctttttttcatgcttgacatattgatatcatcccaccgcagataaaacacagagcagtgtaatatggacaggtgttggaattatttgcaatgcacagaaatctctgctgatgtttaagactaggacaatattaaacacattactttccctgacaggcattttcattacacccatgccatgcaggtgcagaatctagaagtgatatcttgttttccccaatagggtctatgcaatacaatttaaaagtgtgtttgggtgtgtatgtgtgtgtgcatgtatgtgtccttccccctttatatctttatctttgcaacatccacagcctcttgtttaaatcacatctgaattcacttggaggaatgacacaaattccaaagaacctgtagttaaaatagttgctatttaccagatcagtattcttatggttggtagtgtcacatggtcaggtttagagggcaactctgagataggacaagatgaaaaatagcctaggaaagatcaagaaagaccaacatcagaaagccacatagtcctccagagtgagttactatgtagcttagtttcatcaaaaagagaatcatggccaaggtggctgtattagtctgttctcatgctgctaaaaaagacatatccaagactgggtaacttataaaggaaagaggtccagtggactcacagttccacatggctagggaggcctcacaatcatggcggaaagcaaaagagaagcaaaggcacatcttacatggcggcaggcaagagaacttgtgcaggggaactcccatttatataaccatcagatctcatgagatttattcactaccacgagaacagtatgagggaaactgcccccatgattcagttatctccacctggccccacccttcacatgtgggtattattacaattcaaggtgagatttcgatggggaaacagccaaaccatatcagtggcaaattcaaatggctacagtaatgaaaacaacaataacagcaacaaaaggtaatattacttgaggatttatcttgtaccagaaacttttacatgctttacattcatgttgaaaattaaatgctggccaggtatggtggctcacgcctgtaatcccaacactttgggaggctgaggcagacagatcacttgaggtcaggagttcaagaccagcctgggcaacatggtgaaacctcatctctactaaaaatacaaaaattatccaggcgtggtggcaggtgactataatcccagctattcgggaggctgaggcaggagaatcacttgaacccaggaggcagaggttgcagtgagcagagatcacgccactgcactccagcctgggtgacagagccagactccatctcagaaaaaaaaaaattaaatgctcaaaacaaccctatcaggtaaatcactgtaattagcacctatttatcagatgagaaaaacaagactcataaaagtcatgtaacgtgtataaggtaacacagccagtgattcaagcccaggtctatctgactacaaaacttgggctcttagctttttgggattctatactcatggagaggtaaagctcagatcctagaagatcagctggagaagttagtgtatgaagtaggcaagccagatctgaggccaagctaagggcagaaaacaggagtcctgggccactcagcatgcatgctggctcaaaggagtgtgtttctgagcctagaatcttcactgtctcctgctcctgctaaatgttagagacctctaaaataaataattgcagtagctttgtggcgtgttttaattggctaccctctgggttccattagtaggtttacttactctaccctggacctaaagctgcagtgagggttgttacctccagcgaggagagtatttatcatgccctctccagaggtaactgcaattttgcttaagtgtactaatggcatctgctctcagctctgtgtttttcctctctgggtcttctgataaggtcattaggaagtgtgaggcagacaacctgagggctaaagtctcattcagctccatcagtcagattctgctgggactgcacaacccaaggatcctgttacagcatctgcctggaagattcttaagaaggaacttgcagttcattcattacatatgttctatgctgaggcataacagtggaggctgttttacagtgtatcatgccaacagtacatctgctgctggcaattatgctactaacatacaggaccttaagaactcttccttcccatagtttcactgagaaaaacaaaatcccagaagaatattaattgacattaatatgacacaattaaccatttattcaattggcctttccacctagaagtttaagcattcatctttcctgtatttcagatgaacaaaatgagataatgcattcatatactgattcagcaaacatttattatgacttcccatgtactgggtactatatagatatgcgagattaaaacaaagaaatacaatgtaaaaattcagattcttttaaggattccaccgtctactaggggaaacagatgcaatgatgtcatctataatataattttctgtgttgtgatagaatcatacataggacagcatccaaatacagcagataagcaactggctcagctagatttgggaggaggtcaaggcttcatgggggattcaatacctgagcagggtattaactaagagtgtaacctatataaaaggaatcttttttttgagcatttactatgtgttgaactggatgcagagtgctttatgtgcgttgtcataatcctatgcgtaaaacaatccagtgaaatctgtactatagccacatgtctcatgatgatggggatacattctaagaaatgtgtccttaagtgattttgtagttatgcaaaatcatagtgtgtactcacacaaatctagacgatatagcctgttgctatatggtacagcctattgttcctaggctataaactcatacagcatgttactgtactgaatattggaggcatttgtaacacaatggtaagttttttgtgtgtctggatatatctaaacatagaaaagggatagcaaaaacatggtattgtaatcctatgggaccatgatcatatatgcagtttatcattgatggaaatgtcattatgtagtacatggctatattattatcatattataaaatttccaagtgacaaaaaaaatctgaacccctgctctcaggctccagatcccagcttttagcagatatgccacactatcattaactacggtgtttcgcttaggaacatcaccaaacaaagctacttgttcttcaaggacccagtaatcatccttatccttgcacaattatcctggctctatcgtttgatgattttctttctgcaactaatgatttgggtagaaagaaaacctgccgatagtcatctttgatattgactggtcagtcccaagatctaggcattgaagtttctaagagtctctctccagtcctctatattgttctctgcatactcctccaatgtggtactgtactatgcagataagcacatggatgtgacctgatcctcctcaatcctatgctccctgacatctaaaatgggcccagaagcaaaacactttgcctgccgatttgtgcttttcagaagatgagcattttcttttacattctggacacacacataaaaaaacttttctatcattaacctgccacagccttatggaaattctgagaagtccagttcagcctcataacgcgtgaacgttatttatcttgaatgctgcaaatttggcatattggtggggggtgacaaggttaggtagatttattagcatcctgtcaggaaatttcccatgagcggtagaggtttgtcagaaaattcagtgtaattgataggagcaagttggactaattcttagtgctagatctgtactggctctgttcacacctttcctttgcagacaacaagatgtgctgaggagagctcattaagaagaccttcctgcaaacccattctttgcaccaggtttctttttccttcctttcttttatataattatttcagttactggagaagatataagcgtatattggaggcattactgaataggcaatgatttcaactcatttgtatgtatcttttaagtctccaagggaacacttaaactctagggaataaggattaacaagaagccgatatctgttcagtgtttcgctctattttcactaaaggattagaggtttcaactgtcgagtctaaaagccatcaaggcaggatataacagtggaaggaggttagcttttgaattaggattcttgggtcccagtctcaagtctccagcctgcgagttctttggccctgggacagttatttaaacttgctgagctttggtttcctcctttgaaaggtgaggttaatgatgcccatctcacagggttcctaataaatattaaatgaaatgaaaaatgtcacagctacttgacctaagcatctttcaatctctagttccagcactgctgcccctgaacagccttccttgatgtggccaagtaataacagccaccatttattgtgactttatgatgttgccacactctatgcaccatgctttgcatacttcatgtcattgactcctcagaatccagagagacagggagagaccatgggaagagaaagggagagaccatgggaagagaaggagagagagaagagaggagtagggagagagagagaagacagaggaaaggaaaaagaagagagagaaaaaagcgagatgagagagaagaaagaatgaatgagttctcatgtaattatggtcaagatattcatctttcctaagcctcagtttccttatcagtaaaacagtaaattatcacgtcttaactattttgatgactaaacgaggtgatttctgttacatgcaacccacagtgcctggaacataataaatccctaataaatagaataaaatattgttgtttctgatgataagtttcatttttgttgcaagcactcctggcacacattgcattatagattccatccactgattttccgttgtttatttcaatttcttcctcctctactagtctgcaaggaggccagagtcctttttaaaaaataatcactgcgatactgttcatcacacagaaacacacataaattgtttttaaaggaagaaaaaagggaaagaggaaggagtacaggcgcgtgtttggtaaggtgtcaagggtcataggtccttagattctactcaggtttttcttcataaagatgccatttctattggaaagtgatggctctgcctctgaaaacatttcacaaaaaccagaagaggaaaacaaaccaaaaagaaatattgctggaacactatagtgtgggcacttcaatgtagttttcctattccttatatttttccatagttggaattgacactgtaagggacacttttcacaaagtagcatattcccatggctggaacaaaataaccaactttgcaaagggagttgaattacttccattccttgttaggctaaaagccatttggcctagccagggataattttggcctggaaagctcagatttctaatctagcctgactgacctattcccagttccaagattttccacatactttcttccctcactcatggagcgattacatggagttaaatacaatacccttagtggaattgtttggtacaaattgtggtggcattgactctgtccgaggttctgcttacattctgtatgcctggatgctagccgatcctctccatccagtggaatccagccttgtctttatctagcataaacctcacccttcccttgtgatctccaaacatgtgaacagcctttttttaacacacacacacacttctctctcttctcacatcatggccttctttaaatgtcaggtgttttgaaagaagttagaggcctttagaaagtgcaagatacaagttaactctgtttaaagtttaatggcaaaaatcagaataaagcaaaactggatcaggtttacagatgatgagttttgttttccctgcaacaaggttaaaaactttttgagacaacattttaaaattgaatagtgtagataaaaatgagctgtccatgaaaattattagctactcttggcaaatcagaagacattgcaatactagacttgcattcccatgtagcaaaaaatttgctagtgattattagtgattgttttggacattctttgggtatttacagtccccaccattgcctatcatcccactaacaccaaagccaactgccagttctagtaataacaaccaaatatgaaaatgcttgagcaccagaatttgtaaacccagcccatgaatttgcattacctgcttgacctctggggtcgttggttttgcaaaccatactgtaaaggaaagaaaaaggaaaaaccaagttagatgtgttacataatactatttcattatattatctcttttttctcccttctacacttttcatttaccaccactccccaccccctgctacctaaatatctttatcccaatggaagatgcgttaccaaagattcacagtttatggaccagaagaaaaatgtggcttctaagtaagtcctgcagtcttatttctcacttctgtcattgacagccactaaatcaagaagaggttaagtgaaaattagcaaaatatgcattgccatactaacaggcagtaatagaacaatctgttcatgtccccacttcacaagtccactttcccaaaactaatcaaactcttccatctgtggaacttgccacagcaggtctttttcagcaaagaaagagcaacaagtttccctgcacatattttccctggcagaaatttatcaccttatttttctacatttcaaaaataaatattttccccttatacctttcccaatcttattttaaaatggaaacagccaaaagctaggtagttgtcttattctcttttattttcattgaaatcatttcctagactgtatacatacacattatgtatgtaatttatgaagttttgtttatatgagaaagcttcttttattttttaacatgcatttatgttgctttttgggctaatgtccttaaccttttcaaaacccaggagtttttccacctctattcttctgcatcacaagaccttacattgtgtgtgtttactggccttcataaaaaaattaaaaaaaaaacactctaaattcacatttcaccacttgttatctatcaccctctctcatagcttgtgatgtttacaaatgcttctgaagtattcagtccctagagtgagctttctttgactggtgggcaccagtacgatcatagttcacagcagccttgaactcctgggctcaagtgatcattttgccttagcttccaagtagctcagactacaggcgtgaaccgccatgttcagttgaagtccacatatgataacatttctgcctccacttaaaaccctccagacagcccttcaatgacctcggcttacaatacaaatgtgttatgattttccaggcccttcttcatctgctctcccttccttttgagcattatcccatttcatgcccccacacagattctagccataccccatgacttacaatttcccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagcacctatcacactgagccataactgcatacctttctggatgtctctttcagtggaccatagttgcacactctcttcaggaagtgcaacttgtttgtcagtgagtcgccaatgccttatactgtaaccaaaatgcagattcagtcacttgccacctgccgagtccaattcacaagagcaagttctagtataaagaaagtgactttttattccaaagctagcttaagggaagaagtataggcttcctgccttaagagtactgcttacttttggagcagaaagcaggcacttttaaaaggcatcttggcatgaatggctcacaggggagggaaatgcaggtggggtcatgtaactcactgcagtgcctaatctactgcgtggttgagctggtgacagctggtgccttcatgggcagaactaggttgtaaacgtggccaaaactctcctggtgggagacagttttgtagcaggcacttcaggttgtacattgactgttgtctctcgaggtgatctcctggtgagagggagttctgctctggagcttctaagcacatagttagatgaacttgccctgtagggagtgtctggaaaaaggaaggtaaaaggttataattgcatgtctaaagagctaagtaggaagtagggaaaaaagaaaagagaaaaaatacattatctcttataaaaatgggggtactcattacaaaactgtgtctggcacatgaatgttcagtgatgttgactgaccaaggagagttacaaaacaaaaacttggaagtgggaggggcatagcaatcagggtcccaaaggaaagaaggcatacacaaaatggttacatgaagagaaactaatgaagggatttatttcccaggtaagaaaattagcaagtgctggtgaaacacttagggatgagaaaatgtgaaaagtctcaattgtccctaggtttgaatggccacagaagacaattggattccatgaacatggctggtgttgcaaccttgtgagagaggcaactcggttatcactttggtcctaaataaaataacccagctactggcacattcataacacatcagggagggttctggaaggaagaatgaataaatgcccaatgtttctcttattgagctctccactgccaaaatatacaagaagccagaggaaaaagacagtcttatgatgtgatctatacagcttatagcagtcagcctttctagtgggcagagaaggaaaggaagtgaatctgggatgaaagtgagaatatctaacccagtgtacctgcctagcagcagaggggaatctttgactataaaaatgtttcgttgttaaattttgaaataataaatgactataagcttttcataaagtatatacctgtattattaatgttcttatgctaacatatctggttattaaaaaatggtgcttatgcactaataaccaatcagtatacagagagctgtcaagtcactcatctgtaagtgctaccagctggggttaataagcagaactgtgacatgtgaatatttccttcatgcaaacataaacagaaatttgttttattttaaaagatagaggaattctaaatatatagtaaaaatagtaagtgtgtattccagaaaatcttagcaaaaagtcagaactaagtaaatgaataataaatgagtgaatgaggtaatataattggactacagagactaggcaatgtgaaggagagaaatatgatgtaggctttgggaacatgaaaggtagagtttgcttacactgaaagaaaagatagagaaaatgtgaacaatgtgacaaggatggatgttattaaattttcatcctaaattgtaagattcttgtcctcagagaaggaaagagggaggaaaactagtatttattgagtctctatgatatgctgagagcttttacaaacctttgcttgtttaattctcacaagtcactatgagtattattatctcatttttacagtaaggaagccaagacacaaagcagttaaagaactcactggttagtggtaaaaaccaggaaataatcccagattcatctctcagaagcccattccctgtttgcataccatgcaacattcaagaatctagtgaaggaaataacacacctatcaataattatatatccaagacagaatgtaaaaatactatgccagaagtagacagtgccttggtaacacacaggacagagaaactctaatcaggaattctgatccaatttcatgcagtggtggcatttaaataagtctttgagagatttttgaaatttgaatatctgatagacaacatgacttaaaagaaagaatcattttatttatttttgacaccttggtacttgacacaatgtccatcaaatagtaagtttcagtaactcaatcaaaaataaaaatgggaaaaatgacatcaggtgtgttcagggaaatggtgatttgttaaaggtctggtagtgagtatgagggatgggttagagtgaaggctacagctgacatgataggacagggctagtttgtagaggattttgaatactattatgcagagttagaactttccataggtgtgaaataagtagccactgaaggattttgtgcaaagcagtgaaattatgtgggctgcacattaggaagatttctccggggaaatgtagcaggccctattcgagaacagtgttggcagctaagaactgcattagtatgccattgtattcattcaaagaggtactagggaatgaacagcactctgagaatgggaaacaggggccgagctgaatgatgctgtggagatagtcatttctctagtttagatagggagagggaagggcgtctttcaagaaatgacttcagaattttgagcctgaataaatggaaaaattatgatgtcattaactacagtatacaacgtacaataagtaggggtaaaatgaggagtgaaaagtaataaggaaaatgatgagtttggatcatctgtagaaagaggtccagtaggtggttatggttcggattattggatgacatcacagatatagatctggggttcctccacttagaggaagtagctgaatccatgggaggattcacaggtggtgaacaataccattgaggatagagctcagacctgggagagcacatttttaagtgacgggtgataggagaaaaactaatgggatatttgaaaatgagaaattgtcaggttcattgcactattacccccatttttctctcttttattctctcttttctttttgtttcttttcttttcttttttttttcagggtcttgctctgtcacccaggctagaatgcagtggcatgatcatggctcactgcagccttgatctcctgagctcaagcaattctctcacttgagcttcacaagtagctgggactgcaggcacaccatgcccagccaattttttattttttgtagaaataaggtcttcctatcttccccaggttacatttttctctttctgatagtacctttatctagaacactaagtagctaatcctttctacaaaattaaagatagttactttagttgacagttaaatatcctattgtacttaaagttcttgtacattccgacgggttaatcagatgcctccaattccacctctttcaagggtggtgtatctgaatgtcaaggtgattggcataacactaatgcataataaccagaaatcgagtttatcttccaagatcttaatagaggatcctcctcaagagaaaacctttcagacatatcagccttacaactggaatctatttacttttcatttgtttttcaccctatttatgtcattttcctttttaattgccagggatatttatatggaaaagagttttcctcttcttatttctgtcagatcttgtagttgacatcttgtttcattctgtcatgccaatgattaaagctcagtaaaatgtccattttgcatatatggctttctaaagatccatttggaggagatcagatgttaaaagagaggatgtttgttgggggggtggtggtgggaggtgggtagggatagtactttagaaactgtttcagatctaagagggaattaacaggatttcagagggtgcgagaaaagtgggataatgttaagtattacattgaaagcagcgaatgagacctttccaaagtgatgacaaatacaacagaggagtgagggctggggcagtcagcaacacaatttttccactcacttgtggagctagaacataccttccctctgttttgtaaagatgagcctcctccctttcttagaacatttggagaacttcataactttcaatataacattcaagacatacttcaagagttgcccagccacatccattagtctaggtggcacctatgtggttcagtcacatctgtatgaagacttgaagactcccaaggaacttacatcagaaggagagaaaatggggttcttcatggaaacttgccatggatgaaggtacaacatgacccattgactagaccaagtagcgtgacctggatgttgagggaaggaggtggttccaggtcaagtttgaaactggttctgaacattcctagatctgttctcctgccttgtctgtgtgttttggggaagagattgtttgcaaaagaaagaatcctgtcacttgtgtctttactgttcttctgtgggaaagggctctgaaaggattgcgttttgacaggaggaaggtgttgaaccactactcgtagatagacagggaaccctgtgcggccatagtttaggtatggttgccagttctgtggggaatacagtaaaagctttcaaggacaatgacatacgtggcctccagagcatgaggctagaaatctgacatatgcgagaaggtcctctctcacccaaaaacttttacagaaaataactagggagggacatcctagagggcaaaattagacttcttgctaaccaagtgtattagtttcttcttatattgctactcttattcttcttatactacctgaaacagggtaatttatgaagaaaagaggtttaattgactcacagttccacatgtctggggagacctcaggaaacttacaatcatgatggaaggtgaaggagaagcaagcacattttcacaaggcggcaggaaaagaaagagcgaggcaggagctgccaaacacttttaaagccatcagctcttgtgatgaactcactcactatcatgagaacagcatgggggaaaccacccccacaatctaatcacctcccaccagatccctccaacatgtggaaattacaatttgagatgagatttgggtgggaacacagagccaaacgatatcatcaagcaagtgggtgcccaaaacattgaggcaaattgtggagtttctttaagtagaatacatttgtaagttcatagtttcagcttatgaactagctcttatttgatcagcatgagagcatctaaaagagaaataataaaacaaatggatccatctctcattatttccattccatggtctaacttatttttttcttgactacccttcttcctataagaagaagaagagaaaggtctgagaaaaatatgtgcccccataacactctggggcaacctgaaggccatcttccaaaagtcccctctgcctttctcagagaagagattgttaggctgatccatgcttctgtaacacacagtccacaagaatgcatggcatgcagtgacaaaccaagaatattctgataatctcagttgaatctaagcattctatggcagaaactcgcttttagtaatctgctatctgttaaagaaagaacaatttggtctcaagcagtggggaagatcagctcatttacaagactgtcacttaatgaagctccttggtgacttttctgtgatgaatttagacattgaaaagaaatatttcacctcttcactctgctccataggctcaagcagaaaaaatgggagacattgtatttctagtttctttcatccaaagctttgctcacttatgttgacattgtgctgaacagctgacgaacatgcgggcaggccaaggaggatgctgtcttactgttggactcttctctgggcaaagttcattattgtgctggcctcagaccactttagctgccatcagttgagaggaaaagaaagaactgcattaaaaagaatgtcttgcattacaggctttagaggggaaactagtgaaaaaactgctgatgctttgggaggcaatttcttccctccctgcctgcctccctccctccctcccttccttctttccttctttccttctttccttcctttctccctttctcccttcctccctccaactcttcctccctcccttcctttcttccctcctttctagtagatgtctctgattctacctcttttttcaattgatttatgtgcttttgcttggcaagtttgcgctaactcccataattgcttggaagggcggtgttgatttaagccttgtttcattgaaggagaatagcattccttctttcataacagaccaattaaagacgacacaatgacttcttctttctgtaagctttccttgattccctgagccaattttgaaattaaactcttcttcagtcctcctaaactcattgcacagaaacaatcacaaactcacactgtcaggagtggcccaggccatctggttccactgtttgcaagcctccatagtgccgtcatagaggcatttccacagtattctagagacactgtaaaccttctccataataggccagattttcctagcagggactaatactagctgatgatagctaataggtactgattgcttaccctgcctggtgttttacagatagtgtttaaatggcagtatagggttaagagtatgacaaccagagccagagatattgggttccaatcctaccatttaatccctgtgtgaccttgggcaagatgttttacctttctaaaccacagttttcttctttgtaaaatgggaaaaaatttagctactgcaagttgttgcattaaatgagataatttaaagtagaatgtgaatcgtaatacccagaatgttctaaaaattaatgttaattatcatccttattatccattgcttatctccaaatgctttagtgtaattttcaacatggtgctacatagcgaggattatgccctctgaaattgtcacacatcaagactggtggctgaaggccagcaaaatggtaattgtgatcattatctagcacattttcttctctagaagatggattttaagtctctgctcataagctgattggtagtgctgccttagattggtatcttctgttttggggaaagaaggtgattttgccagatttcctcagttttgatcattgggaatatacaataatggaaatttgccatgggaggctgggaacccataactaaacagtccatgataatcctatatccaactcttggaaaagggaaaaacaacacttcatctcaggattgcttcagggtgaatactgtgcctactacccatattaaatgcatttctttatgtccatccctcctctctctctctgtctctctccctctctgtgtgtctttctctctctctctgtctgtctgtctctctgtctctctctctgtctctctctctctctctctcacacacacacacaccccccagaagagcattttggccacttaaaggaatgctgtgaggaattacagattttgactgcgtaaaatattgtgcgttgttccaagcaaaggtaaaattctcaaactgttgaaattgtttttatcagcactactcctaatcataattactgttgtcattagtcagtgttgggtaccactaccttctgtgataacacttaacacattgttagcaattacacagaacttcccaattctgccagctccatgctacatcatcaataccatttcctgtagtagagtgccccctagcacctccacgcttctctcagtttaatttgctttttgagccccccaaagagagactactaaatatcaaaggcagctttcactctttagggacttgggctttccaagtggttaagtgcccagcattaatctcctgagatttgttcatctgacttcacagcagctggaacagggacagagatcttttggacagcctgttctgccagaagcagagcaggtggctttctctcgggtcacaattgaatttaaaaatcccattaattttgtcaagtcaacttaattctcttaacctgataattatcttcctttggaaaaagaacaataaaagagtaggcagacctctgttaagcaatgtttaaagtgtgtgtgtgtgtatgtgtgtctgtgtgcacatgtgtgtgtgcatgcatacatgtgtgtgacagaaagagacagaaagaaaggctgcctgactgattataggtttataaggttcacttcttagttcatctctgaaaacaagagattttggctgctgtcttatttgtccttaaataatttgggtgatccacctgggcattaggtcacagccttgggccctctttttaaagcacttgcatgcctgggaagaaggtggtaggctcttacagcagcaaataagagtgtattgcttaaacctctctttgaaggcagggagggcgagggggaggtgtgagatattttaaaaataagatgtgctgctaaattctctgccaacctccgttcatgctgagtggagtgtaagtaacaagtatcagatagttcctccagatgtcagctatttaaagagtcacatgctagaagttctgtggatagcaattgtcttattcctggtggtggtggtggtggtggtggtggtggtggtggtggtggtgatggtggtggtggtggtggtggtggtgatggtggtgatggtggtggtggtggtggtagtgatggtggtggtggtggtggtggtgatggtggtgatggtggtgatggtggtggtggtggtggtagtgatggtggtggtggtggtggtgatggtggtggtggtggtggtggtgatggtggtggtggtggtggtgatggtaatgatggtggtggtggtggtggtggtggtgacgatggtattaggaggtggatgctgcctcgcagaaacttttatcagcaagaaagtgtgggaatgtgtttgtgcatttgagaagtaagacaaattagaccagagggaaaaaaatgacctaataactcaggaagatcatgatatcaacctttgtacaagtaacatttgatttttaaatgtataaagcaagaagaatgtccaggaactctcaattcctgtaaaattattgtattttccttaagaaattaacttataggccgagaaattatacaataaggaaaatgattcttattcaattttaaacttttctctactgctttacctaaaatagactggaaaaaaaaaagttgtgactgttctcttttgttatctctttgaatcccagtggtaaaggacttcttcctacaagacataatgaattgatctgtttaagttagtaatcactgtgaggaagtggtagggtcaagactgattagagtcttcagaatttccccaccagttcaaatgatgttttcttacactcatgcttaaaagttctgcataagggtcacaaaaattgttaagcttcatttcttctcttctcttctttatttaatttttggagacagagtcttgctctgtcacccaggctgggatgcaatggtgtgatctcagctcactgttacctccgcctcccaggttcaagtgattctcgattctggtgcctcagcctcccaagcacctgggattacaggtgcgcaccaccacacctggctaatttttttgtttttggtagagaccaggttttaccatgttttccaggctggtctcgaactcctgccctcaagttatctgcccatctcggcctcccaaagtgttgagattacaggcatgagccaccacacctggcccattccttatatatttttaaaaataacctgttcttcttcagtttctacaaattctggctttattcttttgcttaatttgaatttcagctgtgttaataaccagagggactccaaaggatgtagttttataatttctctgagggtcagttcttccagttttatatggaagagaaataagatagctcccagctcttggctcattgttggtgacaaactcaagtaacaaacactgcctttctaatgggagatatcattatgctcaattcctcctagtgtctcttctaaaacagatactcagataaaacacttatctctgggagaaacagataggcagagaaaagaagggtatgtgattaagtgaaggtagcatttctagaactgaaactttgtcttttccttcaacttccatggcccttttgagtaatagaacaaagtagagataggtttggttgtgtcaaacacagtgggatcagatgtccttcaaacagactttgagagacagtgtggtcatgggttttattttttttcctcactttttcttttctggaatcttctgcaggcatcccaggttgagacacttgcaaaaaaaagataagaggcagctatacaggggagaatcgcaacctgtgtagtcaccatgtgaccacttgtaaaacagtcccagcatcccatcttagtttgtcccttggtagggcaaggaaggttgtgagcttttgttcgtgatgttaaataaagaacattgtgtgtcaaaagaagtagacttccttatctgctgtttacagctatgaaagaggaggtgttggtctttcttctaagctctatcttccagcttttttttcctaccttctgtttcacatgatctcatacagaaaacttctgactttccaatgtagggcttgttctgttgtcagcatttgtagtcagcatttctctagtgtttttctaaaacccttatctgcagggaacgtcaacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatcttcagtgcattacatgggaaggttagatattggtaagaaagttaggaaatcaatctaatttctcctattctgtctcccccacctttccttttaccgtccattgtgtgcagaattcaagagtgccattcactcagttgtgccagagcataattgctgataaagtagagctgatgaatttgcactatggaatgatcctggtcatatgttttcctgaaattttctcaagttttgcaaatttattttctatttcatacttgtctaatatttttgatatgtacaaatatgtatctaccttattactttagtgagatgggactcatgttctctcatacacaaatacatatatcttatgtatttaaaacatatccatatctataaattatattttataagactcacatatccatatctataaattctattttataagactctagctaaaactgagtagtgttttaagaattgttaaaaaggcagacacgtcttgggatgctagcaggtgggaagtatgatctgtccttaataaaacatgattaatctcacaaaaaaggaaaaactctcccatttaaggcccagagaactaggctaaaccagaaaacagagaggcttgtgttggggagtacttttgacagatccctcacccccatccgcacagccacccacaacataggtgtatattgtctctgtatgatttcgtatctggtgctgttctgcacttctcagtttgggggctgaattcctcagcatccttgccacattacagaaatagaaagcccaatatcatagtcacaccaccaccccacttgccacccacaatgtaacagaagagcaggcagccctcagtttccgaaagggttgtattctcaatgttactttataaattctcagagctcagattatattttccagagaaatggtatattctctttccagaactcaaacacctactaacccagaatattcccaatgtcctagtcaagagatactatagtcaagtacctggccacataggaaatgctttctaaaagggtatgtatttggaattttaggttaggataccaatgacatatttttcaccattacagatttgataacaagatctgggctacccaaacacctacttgctgtctgcaaagatcctaggctagttagttctttatccaggttcatggcaaagtttgagaggagattcaaaggtaagaaaggggctccagctggaaaaggacatggtgaggtgctggacttgatgtgctgggaaggggtgaggaggagggtgagatatatgtgaggggcataatgggagcagtgggaattgggagacacagggagaagaaacgaaagctgaaggagtggactttgagggttaacaaagaagagaagcagaacataattcaattcaattcaacatactttgttgatcacccaatctggtatgtgccagaaaagtgagcaaagttgaatgagatgtgttctccacaggcgagatctcctgtaagggaaggagaaagggacatatgcagatttgcattcttggagcagatctgttcggttccagactagagatgcagaaagggcacagagaaggagagatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttccttctttagcactatgcacatattatcttggcctctaatgagactgcaatcctgcgggcaagttgtggttctcatgggatagaagaagtgaggatgggagagggtaccgaggaggggctctgggactttgagaatttggcagtttggggctagtgggcaaggagatttttcccacttcttgcttctctagatcaactactacctggcctattgtatgactctcagatgctaatgtggtgggagtaaagaaggaagcatgtccttggagcccagattatatttcagggtatccaaggcatcagagaagggaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggaggaaggaggaaggagaaaggaggaggagaaggaggagaatgaggaaggagaaaggaggaggaggaaagaggatgaggaaagagaaaggaaggagagaggaggaggaggaggaagaagaagaagaataacaagaaggagaagaagaatcatttttccaaatatttgtcaaaagcataatgcttctattaaaatgttgaagtgcatatttatgtttcaggaatttggggagaggacaaatgtgtacaaggaggcagtcactcctgtaagtgctgcacacatacagggccttcaaagcaaagagagagttctgcatttcagggaaggcaaatggctatggacattcacagaaacctggagaaagtggatggctcctgggtggatagcaacactgataggtacaaagcgaagaaggaggtgggtagctttcggactctactttatcatcttttagggcctgtgtatctgactactgctgggattgaatctgctggatgtctacagctggaggttaggggatttcacacttaaagtatgggtgtgtgcatgcatgctgtctgtggcctgtttgtttgacctcagtcttaatgatgaactaccaggaaaatggaatttgaggcactcactacctcttggccattcctcaagtgaaaggacacaaagactttatattaagatttatagcaacttcaaagctataattttgggtcttgaacacatcctttaatggaattcttttgttaaccacacatatagaaatctccatgttttcagccacagaataccacatctatataacagactaggcaaatattggcatatttcttttaaaagattaccaatcttaccatttaaatgaatatgctgaaatttaagtattatgttcatatctttacactttgaaaaacaggaagacatccctctgccctagctcaggagctcaggtgaaatgataaaatccggggaaaacatgttttggtactttggtaaatgtgtgtgtgtttatctcattcattagtaaccagagacaagcaggaacatgttaaccatcaaatcaggaggtgggagatcctggatctgatttttacttgtttctatccatttttgagcactatgcctttctaggatttgaatttctcctctgtaaaatgagggaggtaataaatggctcttaatgaaaggtaataaatagtaataaatgaagtaataaatggttcttcaacatttctgggtcacgaagttctttaaaaatataaagaaatctttggactttttttccagaaaaaaaatgcatacccaaagtaaattgaatatagttttggaaaggagtttttatcttatcctaccatagatattatgtactacacaactccgggggcacaattcacagactgtggtgtaaatgacaccaccttggaggtgggcaaagaggtgactctctttatagcagtaccttgaactccaagctaagaactcttttgccagatgagctttaagattctctctggatctgaatttcttcaattccagaaatgtcattattattaccaacaaccctatactaatctggttaggccatctttacaaaatactacagaatgtgtagcttaaacaacagaaatgtatttattttattttttatttttatttttttgagacagggtcttgctctgttgcccaggctagagtgcagtggtgactcacatggctcactgcaacttccgcctcccaggttcaagcgcttctcccacctcagcctcccaggtagctggggttacagaagcccaccaccatgcctggctaatttttgcatttttagtagagacagggtttcaccatgttggccaagctggtctcaaactcctgacctcaagtgatctgcctgccttggcctcccagagtgctgggattataggcatgagccatcatgtccggccaacaataggaattcattttctcacagttttagaggctggaagtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtatctccaaattcaatataggaattttaagagaacacaattcagtctgtaacaaatcccaaactgataaacacattgcagagagtaactagaaaaatcaaaacatctttcagatcccttctacatgcaaataagtctatcaaaaattagaatgaagtatgctacttttcaaaatgggaatttatgataaataaccagaatttatctgctactatgcttactaaaggggaaactgttacagaggtttatttagtattacatatacacgcatgtatatatctagtatatatgtgtgtgtatatatacatttatttaaaaactaacttgatgttgtataaaataaattaacttttaaattaactggccaaatgtcgtatatagtaggacaaagaatgagttaagatggaaaaaattttaataacctataaacattcttagtttttgtttttctttgggtcctccaagtgatcatcttcgtgtaacataaatcaaacaaccaaaaatctcttccacatctggtaagtgagggtaggaggaatgggggttgctcttttttttttttttttttttttttaaattttcctgatttttctttaactataatggaggatcaggggctgagaagaaaaggccaagagtttcttgtcatttttatttatgtatttattatttctcccccagtgccacatatagtaaccaccaccttctgagtaattcccgaagcaacaaccattctacaccccacccccagttaccctagtgccaatggtagctaaagaagagaaatgttcaagaagaagatttacatattgctggatgttcttattcttaaagcctcaccacgattctatggctgtatagtccattcagcaatgagtcaagcctgtgagttagcagtgttacagactcaccaagaatgtatggcaccacccaatagcatactgtcctttcatccttttttgctttgcatgtactgacctttttctctattcatcttctgtacaccgacaaggtatacattttaggaaattacatctatcaggcacaatgactccctctgtgatgtttcactcccacgcaacactcccttggatgaaatggcttgctctctgcctgaattgggctaagatatatgcctgctgagggcttctgccctcccatctctcttctaccacccctgccttgtgaattatcttctttattcctagggaatctacagtaaatactttgtcatctatagtcatttgcttgaaattaacaggtgggtggttggccaagcaaggcaggagagacgtgggacaggaaaaataaatagtaggcacaagcataccagcaggtgttattattccaaagctgtgtagctctttagcccctgtttctattataaaaattaaaatttttaaaaggcacctgggaatctataggagagagtcagtggttaagtgagttgcctgatatctggcaattaatgtttgagccagggactaaaatccagatatttttgattcctaaagtgtgattaaaatatgtctcaaccatgacatattaaactattggaaatcatacgtaatacagtcctttctatattacttcaaaacctggtttaaagaaacaaaagtatgatttttttcatgacttttcaaaagccttctgattttctccagctataaaggttatatatatatataacctttagagccaaatatatatgctttctcttctttctcttaaaggtaagctttatgctcattattgggactgatgttattgatcatatcagacttctcttttggaataatgtttccaggattttcactttgagaggatcaaaacccaaaaaacatcagatgcatttttctggcatttagttcccaggttgggcagtacattttcaaagtataattgattttgtcaaggtcttgagtttgggagtgaagactggagtatcaggaaatgtacatctctagccatcaactagtaacaagaatggcgtaaatgttctagggactcactctgacatccaaagggaagggagcaacttctgagattaagagacctttggttttgtgatgggaacacaaaaagtaaacctatttgtccatatctcctaagactccaacaaattatatgaacaactgcaagttatctgaatatggaatgaattatggatcatcaactaatttaatgtaaccccaggttgcaattcccgtttttagagaggtaacacaaaatatttttaatctctaaattgtaaattgctcaagcaccatgtaataaatatcaatatctaacacaaatgttttggtcatcacttaactatcatatatataattgaaagttgactgtaagtattgcacaggagggcacaaaagatatgtaaactaattattatccagtagtccacactgactatcatttgtatgtcatttgttttattttattgcaaagtaggcatgttgacacgtgtgttgggtgacctgttataaacatatagaaaaacaaaaggagagaaagagagataataatttgatcacagttctctttctaaaagcattgctttaatattctcttatatacaggtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaaccgttctcatgcctcagcttccctagtagctgggattacaagcatgcaccaccacacccagctaagttttgtatttttagtagagagggggtttcaccatgttggccaggctggtcttgaactcctggcctcaagtgatccccctgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacatttactcccatggaacatacattttagtgggttttttaaatcacagatttgtcattttttttagtcagtgtgtgctttatatattttgaggttatgttattaggtgatacagatcaggactgttacagctgatctagttaattgtttttcttcaggatataacgatgtttttagatgtaaagtctattttgtctggcaataatatttccgtatctgttttcttttggttaacatgtttcaagcatattagttagaatatttgtttgacagtatggtagttctgcttctctaggtcacctccagatccaggttgcctttttcttgttgctcagccacagcacattgggcaacctatcagttcagcaaatgttaaccagaagaaaacatgtggtaatgtccacatgggcaaagttggctcatcacctcatccacattccagaaaaggggcaaagagaaagcagaaagaaaacgtcagcctcttaaggtatgacttagaacttgcacacataaattgcataggatttagcaacagaatagtaatgccatttagaccgtagacacagtagataggtggtttgggttcaaatactggctctggcacctcctggctgtgtgagtatagacaagttacaatctatgcctcattttctccaattgtaaaacagagatacttataataatatatatcttatacacattaatcaagtattggttattattattacctttatttttcttctgcagtttctagaatgcctttgtttaatcacttcaaccatatttattttggcaatgtatttcagattgttctattacgtcacattatttgatcccttgttctaccattgttgtggttattaactctctctcatggtggactattttcttactaaatttttatttttcttattttattttattttattttttgagacggagtctcgctctgtcgccaaggctggagtgcagtggcacaatctcggctcactgcaagctccgcctcccgggttcacgccattctcctgcctcagcctcccaagtagctgggacttcaggtgcccgccaccacgcccggctaattttttgtattttcagtagagacggggtttcaccatgttagccaggattgtctcgatctcctgaccttgtgatccacccaccttggcctcccaaagtgctgggattacaggagtgagccaccgcatccggccctatttttcttattttgtactgaagtttatgatactgtaggagctatgcatgcctcactctagaagaaaattccagctattctgacattaatatagcatatgatactaaacaagtcactctcttctgtatctgagtttatcctaggtatctcctgaatagctaacatccttctttttcttaccggcgactgaggagagatggccttgtgttggttagacagagcaaagtagttctgcagtctgtcccacggttctcaggctacacgtctttatttagggtgattcatttttatttatgtttagcccaccatagttccatgctgaagaggtaaggaacaatagggtaagcaagccagccagcatattcttcccataccgatgagcttttcaccagaggaaaatgccctctcagatcacagaaacagtagctgtgtaggtgttgctagtggagaaaaaaaaatgtttggtatttaaaatagaaacataaaattgttaataagtctacagacaacttgtattgcatgcagaaataaaaaatgaagtcctagtacaacaatactgcttagtcttggattcattttacagaagtttaagattcctcacctcaatgaatgagattttaataaacagaagtgtattagaatatttgcagcatccaggcattgggtttgagcctcaaaataaggccagggatgacatttaagtaaattcagaagtaaaaagcaaatggaaaacacttttaatgatgtgtcacataatgtaaaatgtgaaaaataacttagaggttatatactccatcctcttgcttcagggtccctaacaggcatctctcacttgagcataccctgtgatggggagctcactgccttgcagtgaatctttgattttgctgtggctccaaatgttggaaagtgattccttatgagataattgcatattttggaggttcccccaccacacacacatacacagaagaaatgttctcccctatagtaattcaaaatatctcgatagtattgcacaaatatccattaagtgtctcctatgggcctaaaactgtggacaattggagataaggaatattgtcgttttcattttgcctgtgagaaaaagagttttcggaggctaggtaacttgtccaaggaaacgattgagcagagatttgaacttaagctctctggccctggaatttaagctgtctggctctaggactaggccctcattccctgcatgatttcagaattcatgattccatgaatcatgtagggaacccagatataaatcaactgataataacagaatgtggcaagtgtgaacagaactgtactttaggaagctaggaaagaacaactaattctgcctgtccagattggaaatagtaagttttgaagacatagacaccatcaatgccaaagtattgttatcataatgttgtttcacctattttaagaaaaatctgtttcttctacctatgacataaacttacatttcagtatcccccacctcacctcgtcatcagttttagaatgtgctaaattctcaatactactgagaaatgcccttattccccatattgcaaagatttctggggctgcttaataacactttgtaccttctgttcagagaacattcatcttattctcctctcaaattctctgttaagtaaatttaatactacatagcatcaagaggaaagtgaccatttattttagatctgtatctatcttagacgatgtacttttcatggaatagtgagtgagacagacacttgagtcaggtgatgtttgaactaggatgttcccagaattaaatggtagtctcttaaattggatctcatgagtactttagtatctgaaaagtaactacatggaataaattaaacagaggaaaactcctggctatgccattattaaacttttttaaaaatatggtctttatttgacatttctgagtatggcaacccattccttggaaataaagaatgtggcttccaacacatgagtttccccctccctctcccctcccctcccttaccttcctccttcttccttccccttccctttctttcccttcccctttctttcctttcccctttttttcccttcccttccctcccctcccaccccttaccttcccccttcctgtctccttttttccccttccctcccctcctctttcttccccttccctttccctggcctgccctttccttccctttctcccttccctcccttcctcttcccttcccttctcctgccgtgccttgcctttctgtatcccatggaatacctctcttttgcattggaagaaaaacttgatcccttttggagctctttgggctttaaaggtttaagtgccaagtgaacgctgggcttgtttgcctcctttaggaagccccgtgtggatgattccacccctcattgataatcttcttactttacactcccctttctctgccaatttaaaatcattcaaaatcaagttcatcataatagtgaacgtcaatttacaatgctcttttccaagataacttcttttcaaaccctcaaaactattctatgaggtagagatgattcatagttgtacagttgaggaagcaggctcaaaaagtttaaggtaacttgttcaaagtcatatagccagtggacccaggatttgaactctagtcttttaacactcagtttacgtgttaccttgtctatgaatccttcttgatggtccctgctttccctgccgtagatcagtagatcaattccattctctattcccctgtgtgctttgtttatacctttgttctagcacttatcacattgtatttgggaagcagtgtatttaaatggatttgtggctggtctaatttggtttaggtttttttttttttttttcctgttagtttatttacttcctaaggcctgaaatctcttcttcattatttgacctgctggacttcatgcagtgctttgcccatagtatgtataaatttagtgttcatggagaaaatgaatcaatgcaccaaagtgaaggacaggggctgcggtttctttgtatcctgagtggaacctagttcagaggtacagtcacaatcacttttaaaaaaatgttgaataataatgaaatactacataaatccaatagaaattcttaaaatatttagaaggcatgttttctaggaagaaggctaattattagaatttattttttattctagagaagaaagagagaaaataaagaattaaagaaataggaaagagaagtcactagagagccctttcacgtcccagagcagattaggatcttgagagctctaccctactctgacaaataattacttataaaacaattctggggtttcatagcctgcattacctggttccagggaccaatcatgagcttcgttgttttggagttggcttggaggacatttataagaaacatgtgatgaagttgcccctttttctgcagaagataggcaaagagaatcccatgagttgggtaacatgtgggacagattttgcattccgtgatttgaaattatgggtgggggccgggtgcggtggctcacgcctgtaatcccagcactttgggaggccaagacgagcggatcacgaggtcaggagatggagaccatcctggctaacatggtgaaaccccatctctactaaaaatacaaaaaattagctgggcatggtggcttgcgcctgtaattcccgctactcgggaggatgaaaaaggagaattgcttgaacctgggaggcggagattgcagtgagcagagatcacgccactgcattccagccagggcggcaatgcaagactctgtggccaaaaaaaaaaaaaaaaaaaaaaaaaaaatgggtgggagggagggtgtttactccctgccctggagatttgtataaacaggaaaagaagactgttttcttgtttagtcttttaaactaaagacttttctctcatctggagaaaaaaataataatggtagtaataataataataataaaatgggccgggcacggtggctcacgcctgtaatcccagcactttgggaggccaagacgagcggatcacgaggtcaggagatggagaccatcctggctaacatggtgaaaccccgtctctactcaaaatacaaaacattagccaggcgtggtggtgggcacctgtagtcccagctacttggaaggctgaggcaggagaatggcatgaacccaggaggcgcagcttgcagtgagccaagatcgcgccactgcactccagcctgggtgacagagtgagactccgtctcaaaataaataaatacataaaataaaataatttttattattgatcatttttgtgtgtcgggtactatttctagacaatttacatgtattaactttaaacttgacaacaaacctattagatagatggtatgattactcccatttcacagatgaagaaactaaactacaaagaagctaagatcgagccgggcatgatggctcacacctgtaatgccagcattttgagagtccgaggtgggcagatcacgaggtcaggagttcgagaccagcctggccaacatggtgaaaccctgtctctactaaatatacaaaaaaattagccgggcatggtggtgcattcctgtaatcccagctactcgggaggctgaagcaggagaattgcttgaactgggacccgggaggtggaggttgcattgagccgagattacgcactgcactccagtcttggtgacagagcaagactccgtctcaaaaaaaaaaaaaaaaaagaggctaagatcttggccacgttttcacagcagctaacaagcagaatcaggatttgaacctaggccgtggagcaccagagcccattctaaatctgaatgcactctcaaagtgtcttgcagggaggtgagcccagtctgtctctctcagacttcaagaccatttgcagtggtccccatacctattgcaatgattctgaataaagtctcctgtaccaaaaaaataaaaagtattctctaaatctttaatattttatcctagaaacaaatgagattattccttcttttattgtgataacatattatgataactcattttatttgattccctaaaaccggacagagatttccatggtgctgaggatacgaagtttagaccttcgatagctagtctaagcttagtggagatctgatatccaatctaagcttagtgaagacaaacaggttgtaaatgcccaaatctctctatgagaaactaattaagccctgcctttgagtaaaagagaaaaaaaaaaaaatgcttctatattaaaataacttcatttggagttcaaaggaagctaaataaggttttcacaggaagagttcatatttttttaatccttaaagtaatgtgtataagtttcaatgaagtaaatgtcccagctacattattcaaactcaagagattaaaaatattttttttccaacatccaaactcctgatatccctatttcagccacagggaggacaagggcataactatggatgtttattagaaggataagttaaagaggcagaagcagtatatacattctctaaactatacatttatacaaggatgccattgtctttttttaagcaaatacttgtagaagtgatgtctaaaagaataaagcttctcttctatatctccaaatagaaaatataatcaaaatccgcttttatgtaggatggcttttttaaataaataagcagaaggatgaattatgtggctataaataaatctactgacatgtaataaagcaaagtcgaactgttttatggtgtcactgaaacccttagatatatttatagccatgttaacagtccccagtattttttcaggacttttatttcatttcacattatgagagtttagttgtttgtttttctctccctaaattgccttctggagccctttgtagagatagaaagtaaggatctctactcttcatatttggaaaaaaaaagggtcttcaccgaaaaagcttagggctcacacagaaacagtcggttctgatgctttctggtctgcctgtttctgtgcagttcatatgagatgtgcctgcgaagaacaacttgacaggtagctcctgctggcagcaaagtggcaagtcagagtctatacaagtgaggagaggcctgtgcagagataaaatgtacagtactgtagaaaacaagcagatggacagagcaactttgcattagattcctgatgcctgacacatttaaatacaatcacaaggcttatttcagaagccaaagaatctccagactatcacatagccgaggcacagaccaaaacaagataaagggtctgatgggtaaagatgctcacaccttaccctgggacattctcttgcagggtgaggatggggggggggacatttaaaaagcaagaggagaaggtttataataccagttctaaagcctgaagtaatataggggttttttaaaattgtattccatttagaaatttcaggatccaaagagtatggttaggattccgtggggggtttattcaagtggagctaagcgtggttgttcctgtgaaattatttatatttttcaacttgaaatctgggtgagcatagtgtttctaaatctatttctcttcttttctatcttaaaagtggactctcattttcatcctgtagctatacacttgattcccaagtgttatcactcaagggacccactagaaaagccaactcaagaggaagaggagagcttttgatggtaggacaagggatgacaaatccttcagctggaactctagctacaggcagtatttagaaagtatcactggagctaaaaatctttaaaaatgtatttaatgtgttagactaatataggctctaaaagacctaaaaagaacaggatccagaaaagaagtcgaaataggaatgtgttaactagagggaggggcaggagggataagaaacacatgaaaaaattaacagtggggtaaattggagagggacattcattttattaggataattgggggttgtctctttgtagtggaagaagtaaaatagacctgtcttacatttgtcctctgaagagtcttctcagtatttaactgtgttcccaaatggaatcagccttaccaaaattcacggtgacttcttttgacattttgcaaaaagtaaataaataaattataagtatgacaagtgaaatgaatagttccagctgtgatgcaccagcagcatttccagattttgtactgcattaaggatttattttctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagacaaacgcatcagcaaaattaatggcataaggaaaatgtgagtatgagattggcaattgattcactgagttcgttcattcagccagtatttactgagcccgtatgatgtgctacctattttttcacacacacagaaaacaggagaaaatgaagactcagccctcagagagcttataaccattttaaggagataaactatgaacaagtatacagataaaataatttcagacactggagagtgctgtcaaggaaataaaacaaggtaatgggaggggatgccttccaggggtggtggtcaactttaaatgaggaccagagagggtctctgaggaggtgacatttgaaatgcacccatcacatgaaaatcttggggaaaagccttccagacagaaggggccaacaatgctataaaggccttgggatgagaaaaaacttcccacgatcaaagcagaaagacctggggaactagagagtagggaggaatggggcatctggcaggagatggagctgaagcattagagttaagcagagtcatctaggccgccttaaggccaaaagtgcagtggaaatccacctggggactaaatcaaggagtggttgaattgagtggaaattatcatggatatttaggatattaagaattttttctggcttttctagcaataatagcataagaccctaaccatgtacttaacctgttcttcacctttttagagcttcagcttatttttctagtggacaaagaatattgccactgtttgtcaggtgctctaccagatactgtatattttctcattttaaacccccaacaacctcgagagggaggcatattcctcattttacagaggaggaaactgaggtttcaatggaatgtccataaaccaccccttccccttgctgtggtgtccctgagagcatgctgctggtttaagacactgcgtgggggcacacccaaaagtatgcaagaccttgtcagagggccatttcctggggggctgtggatcctggaccacccttacaaatgagagccagggcagttagggtgactgtgtgcatcatttactacgggcagcttgaagcttttggaggacaccaatttcagaaccagaataccagttcactgccataaattctgaaatggacttgatgtatgaccttgaaggcaaatcacctgtaggtttggtctttttgttagagagacataatgctgtttcctcaacacctccttggggtgtctcaaggatgaatagggctgtcttaatccctgttctttatcctcagggggtttgaaatgagagtggagtatataataggtgctataagctccttttaaaaaagcctcctaaatacaacatatatatgttttaaccagcaagtattgttcactcacctccccttcctccctgcaaatgtaatgggctttttacccaaggtgaatggtaggagggagtcaaagctagcaagacctgtgtggacaacaacctggcctgagagggcagcctgttgggtttgtccttcctgcgcatgagacatactggaggggtggatgccgcctagtccacagtgttaccgtgtcctggcagagccttgggtcagtcccctcctggagtcacagatggccacgacagaggacaggtgctgccattctggctctcccctgcgtgttcagtcgtgaggtaaacaccgtgctgtctttgatgcccagcgcccaggggacttcacccacctggggcagcccttctgcagccagttccggacaggcgccagtcacttctctttgagccagccgacttggccctctccccttctgaagttttttgatcaggactacaggcgcggacgataacctctggattttgaatcccaacagtgtcctatccaccaccgggggtggcagccaccttctggaaggactgccaatcacggagcccttcaccctttggagtccccaggccaccgctccaccttcacttttgggagtccggactcagattcccatcattcgccctgcgggaggggccctgggcattttaaccccgggagacacacgcgcctggagagtggtcgcccaagccaccgccaggcagggaggagcgcgcgtgcggcaccaccgcgtgcagcagctccagcgctcgcgctgcctcaaggggtttatttttatttctatttggagctacttcggccttagccgccgcccttacttttcctccgaaattgtgagaaggtgccttcatggctggagtttggtttcacgcgcctgggagaagagcagggcacgggtgataaagaaggcgcagtgtcggtctgtcggtgtcacacacgcgcgcacacacggcggggcgggagccgcgcgagcgagaggagggcgggcggcgtgtgctggaggctcgcgcgggtgtatacgagcctgtgcttgaatgggaagggccgggattccgggtcgctctggcccctccttcctccggagccagccagtccctcggcagagcgctggggctgcactgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 1929 - DNA, 54270 bp, Homo sapiens
tgtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1930 - DNA, 54270 bp, Homo sapiens; identical to SEQ ID NO: 1929

SEQ ID NO: 1931 - DNA, 54270 bp, Homo sapiens; identical to SEQ ID NO: 1929

SEQ ID NO: 1932 - DNA, 48474 bp, Homo sapiens
tgtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttg

SEQ ID NO: 1933 - DNA, 72 bp, Homo sapiens
ttacagcatcagcagcatcatcacgcttcttatgtaaactatgtaataagtaggtttctaattcatgatact

SEQ ID NO: 1934 - DNA, 74417 bp, Homo sapiens
tggtcggaaggccccggctgggaaggattcatttggaatctttcttcttcttctttttcactagcgtttcttctagtgtagcgtcctctgctatctctactggtttttgcagctttttcttccctctcctctttttgggcttcagggtgaagtcccggccctcaggcggctgcacatggtcccctgcatcctgagcagaggccttggaactctggtcccagcaggggcctctgagctgctcttctgctggcgcgctcttcttcttggccactcgctcctgggcctcggccctctcgggctttccctccgtgtgcctcttggccttaggctggaggtaactttccacatctttacctgtggcctctttatttcttttcttcccccttttacgttccacctgcgtctcagaaatgtcagaccctggaactggaacctggggcttgttcttcagtgctgccatccgcttggcaaagtactcctggatggtgaaggcgctggttgtcgtggtttcgttctcctctggagtggagggactggcatcgccctatggtgggcagaagagttaaaaggcaggtaagcatcaactgttcatccctcaccgcacccaggaggcacccacacccggcgctcacacctggcacccacacccggcgctcacacccggcacccacacccggcacttaggagacaaggctgagtgacacgctccctttggcctctctcccttctggtcggcctgaactgcaggccgggagcaaggcggccacacactccggctgggtaccaggtggggtggtagatgacaggcagaagctaatgtcagaagggagcaggcaagccgcctcgatggaattctgagtaaatgtctccctagaaacaagtgttgtggtgactaagctcccagaatctcccatcagaaacagggacactggtgttccagagcttggtgattttgttagacaccgatttcatcttcattatgggttacatgggcccctgtgttgatctagaaacttagacgccatctggataggttaaccttccatgaggacaggagccgcattccaccctggaacctggcttgccaggggcaccctttctcccccaaaggtggagcgtggccgctctggcagctgctcctgaagggagggcagagtggagactccgcgtgtctcagcctcctccctgaaccaacaggccagcttgggggcttctttccctcagctgggggtggggagtagagaaatgccccctccttccctaacaaaaactgtatactcgggactgtgtttgggctgtttttaaatgtgagttactcacacataacagctgggattaggattttaattttaaatgagtatatctcattgtcaggtaatatctgctataagaaaaaatgtgaaaaatgtatatatctaaaagtacattttgctgtaaagcttgagaagcgagagaaaattcctaaggggagaggctgggataaagaatgaaatgctggaatcgccatttgggctgaggctggcagtaaggtgaggaggagtgcctgtgaggcaggaagtgctttcgggttgaagactataaggaatatgctcggagtcaaatcaatgtctgcagcaactctgcccacagagactctggaaataagtcattaagcaatcatgctaaacttaggttttcatagtcacccaacttcttccttcatactcatttatctcacaagaagaggctgggtgttctacgctttcatgatgggagggtgggaaacggctcctgaataaagaaatctccaaatcaggattctactaatgatcctaaacttggctggcaaggttctgcttgtgcaggtaactgaattacaaaccacctataaacagaccctgtattgtctcgacacagtggtcctcaaaagccacctcagtggaatccaagataatgtcccagttgcagttccagcagaatcgatattaatatgtatcaatggacaattgggccttcagtggcaagtgcctcagacagctttcaccaaggggtacattaaaaaaaaaaatcatgtggtcaattctggaatttcaaaataggcagaacatgaagaataaatcaactgagttttgggaagcagttttaattttatctattactattcaatttgtgctggaattccatagggtgattttgagaaaaataaaaaaaatctgcctcaggagatttgtctttttgttcttcaaatgttgaaaaagagctgaaatgctgcacagcagagtgaaggatcttctcaaggctctcccggcacgagccaatcccaggctcatgaacaagaaagatcctgcctcccaaagacgggcaccctcacagccacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacaaagagacaggctcggtgaccagacaccctcacagccacacagagacaggctcggtgaccaggcaccctcacagccacacagagacagactcggtgacgacggctggctcgtttatgcaacagaagtctcactgacagtttcgcagcactacaggagcctgcagtctgtgggccactcttttggaatgtatttttgaggctggaactcagatctgagtcgaatcctatgactccttaccttgctcatctatttattaccttgtgaattcctgattttaatcaccggaactaattgctggtattaatcacattttttattatcaggaaatacaagaccatttttgagtcacttgttgaattcagcgggtcttcgtaactccagaaagtaagtatgctcatatgctcatcatcaacttctgggatgtaagtttaataggcacgggtcactgcacaggcttggcagggcatggagacaggctagagaggggccagcacccaagtcctacttcttcccagcaaagtgctggccacacaatgactggctagagagagctgcttaatgcgggggtagccaccctcccacatcacagaaacgtgcctattttacaagaccatggactcaaaggaaaaatacattgaaaatctgactcctgcaggagcaatggccaggactcatcttttatacaccaaagtcggagactcagtttcactgcagagattctaatcctgcttctgcattcttgaccatggcatcacataaaaatagatacatcttttcaagaaaactaatgcttttacatctggtctctatcaaagtaaacaagtattgagaaaacaagttacttttaagcattttgaaatgacaataacttgcattttcccacatttccattaaacacacaatacacctcaaaaaataaaataaaaaaaaatttaaatgcgacattcactgcttcataaacgttgagaatgtctgtttgctaactgtgtgccaaaacctaatgaaacaaatttaagagtaacttgaaaacttctggttccatataaaatactaccaagaaatatggttaatcatcttgccaaatgtgatttaagctcagggattcgggaaatgtctctctctctttttcaaattccaatgcttgctgttcagctaaaggaggtttttgccactaatggcaaaaaccgtgattacttttgcaccaacctaataaaataagcaggactggcctagtctgttcacagcaagcctcacagtcctctcccttccttcagcgctaatgagtgcatcacatgtgtcaaaaacatttgatgactgactttcccaaatggtaagtgggccttaatttctacccaatcaataagtacttgtggctttgaactgagatgactctggagcacctgttccccagttcacagagccctgagagtttaaagccaggcccatgggatcaccctgctcaatcatttgaggaagcttcacccaaagtgatcaggcctgggtgtcctgaggaaggcagctatcaccaccgtgccaggcacttgacatcaagtggcatctcagccaactcttgctgcaacctgaggagaggcgtcctctccacatcacacaggcagagagtgagactcctagcacttaatccgcagaaggtctcacagctggaacacagcaggagagagacagccctaaggctgccaggtgcaaagcccttgctccctgtaccacaggaccccgactcctagctcccacctcatggactgccttgtcacctttcctctctcttcagaagccaccccaaaactaaagtatgtatcaattgaccacataatccagagactaaggtctacactcacctaagttgactgatgcagaaaaaatatccacagaaatagtactttcaaaagagaaaaaaactacatcattttggtttgcaattcatataaataaaaaacagcctgaagccaggcttaaaagagttttataatttatcaaactagcatgtacattcacttgaaaaagtttgactgttttaaagcacagagtaaaacccaagtccaaaccttccacccaggcaagaagccctcttgggcagatgctggacagcttccacctggacactgccaatatggaaaggtggctgctgtggttctctgactcagtttcctcatcagcaacaggtcaattcaggtggttcatgggcgtacactgtgtgtcacgattagagctggagaatcttaacgccatctctggcaattccgaattatcactgaggagaaaacaaagagtgggcacaaaggcaagctgaccctgcagagagtccctgcgggtatcaattacaatacaccacagtcctctccggtccctgaaagatgcctgaagctacatgtatcaactcttctcggatgtctacagaattaaagtctgttctgcttcttttaggatcctccatctggagactctgcagctacatgagtgagtatctgcgcaagatcctctgggctcatggaggactttgctcttgtgtcattcaaacatgtatactgagatggattattagtacaatgcccaaatagagaggattctccattattctcaaaagaatcttttggggcaaggaaatgaagcagtttgcacagagaccttagtgaagtgccagaagcagatgcaccttactacagaatccccctacttatgatcaacatgccagtccaggaaatgggcttcaaaggcaagtctttcagctcgccagccttgctcatacatcactactgatcttaagtgacaggatgatggaagctttcttatttccacattaagacacggaggtcatgctgcaacagtaatccttcaatgaactttgttaacaaagtagactcccagagatcaagggtaatgtatttagcaactggggttgtgagccctgatggctattgcctgtgatgaacaaatgctcactgccaccacagcctgtctgtcatcagcctgtgctgggttagtctgtgaaaagttaagaaagcttggcaagtgagtggtttgacagaacattctgtaccttttccaaacttttcagtggggcagttctgacaaacacaaattatgtcttcatgtatcccttcaggtatgaagtgactgtgtgtgactcctcaaaacaaagggattgtggagaccccaccgtcagctgtgtgtgtactttaaactcctccaacagaaggggcaggatgaactgacccagtcactccctatgctggcctacgatgttcttccacatcccctgtacacagtcccgtgcatcactttcttgaagatcaagtgtgtgactgcttccttccacaagtccaatcccaagtgaacatcctttcttgtttattccccataatagcaacttgttgcttctattttctgtatttgtttaatttgctttgctagcatcttcccaaggaaacaagtttcttgaggacaggggccatttatgttgcatttgtattcatacaatccacaacctccctaatgaggaacaaggtacagtaagtgctcaacaaaggcacaaagacaccaaacccagctggaccaaggctgtgaagagctcccaccaccacccactggccccaaatgctttgtgtttgtcagtacgaacttgtctgcacatcaggcaggtctaatgtccagaaggggtgtgggagggtaagaagagaatcagcattttgagtgcagattcctcccatccacatgaaaccacccccttctcatcagatagcaccttcccttgcctcgtgatgcaaactgcttctctaactactgcagagtacatctgagtgtcgtctgctgtcagccagttccttcctggcccttagcaataaatagaaactcagtccagtgatccatccatttctccttctgctctgtcattccacatgttaccacagttgccttggaggggacaagtcaattggaaaaaagcaaggtactgtgtggtatgggaactgccacgttctttttgtgggattagttgaacacaagcaatgccagtagagactgaactgttcttgctaaagaagagaactgttcttggtaaagagaagagagttctcgtgcataccacatacaaaggtaagcagctcatttggagaacagcagtgggatggaagttccaccagcagcctctggtagcaagctgtgaaggcacagcctacattatatcttagctgaaaacaacctgggcaagctgattctagggagtcattgaaatgggtttgccactgaaggctgagctaggcagtgattcacggccgttcgttggaaagcctgccctgagccactatggcgggcggccctgctcttctctctatggaacctctgtggtttcatgcttttccttcgtggtttccatgtaactgaaaacacccagtgttttattgatgaacagctatttttacactcacaaaaagcttttcaagtgtgaaatcttgtacatttttcaagacattcatcgctcacatctggaattaggctaaacgcaccaagtctcggcaatgagcagcctcggggaatttgcctgggagacacaatcagttttagcattagcaagtatcacaagagtcaaaaacaaatataaaaccccattgactgaagagagttgtgatttgaagtggtattaaaaagcaaagatacaataacagaatgagaattatgcagcaactcaattggaaaacacagaaattgtgtgtgcgtgcacatgtgaaacaggtgtaagaacctgtggcatgtattagaagcccactctgcaggggttccagagggttctctctagaacagagactggtgaactatggccgtgggcctagtttttaatgatttttttttttttttaccatttctaaatggttaggaggaaacaaaaaactattttatgacatgtaaaaattacatgaatttcaaataccagtgtccttaaagttttgaatttcctcagtaaaaatcttgtaaaaatttgttttctttctcattatacaagtacatacaataggtgctaagtaaatatttactgaataaatgtattataaaatcggctctgtgactgtgaatacaatacggctgacttttggaagtggcaggtgcttttccagtgcacacacacaatatacctttatatacacacatgtacatatatacacgtatggaactggaggacgctgggctttgacaaagtcctcaagctctgtctcctgccaacgacagaatgcctacctttctgaactgtgtcagcaagcagcagagaggctgctaactgctgcctgcttttgagtagcaaaagccagtaaagaaaaaatttgtttaaaaagtgatgtgacatcaaagagcactctcagcaacccagtaagtatgcagagatacctttctaatatcaggcatcagaactccgcttggaagttacaaactcagacacaccggacattggagaagataatacgaactagaagggacagaatagcttggctggactttagtagagaaatacacagaatgccaaattcctcatatgaaggccaatggtaacagagctgttaattttatgtctttttatttttattttttcccatatgcctaaccagctattccgattgccacttattaggaaaagccgacataaacatgttttaaaaggatggttctctatggcaacagcttctcaagtaatcaacatcaggatcactgacaagagtcatccagcctctgtggaaaaagaggaaagagaaagaggagcaggcttcctgcctccctgaaaggccctcaggctcggaaagctgcagtgacaaactttcccgacacactggccatggaagataaacgaggctcctccagagctggagatgatcaatgtgacacaggcctcaacttctgtgaatgatgtctaaaaataatccaaattgactgcattttataattccaggtcaaatcgttctctcccctgctctccagaggcaggacaaacagctttgataaacagctgagacccagcactggcctctcacagaacagagcagaagcttccagagggttctgtctcttccatctttattccacaggaagaggtgaaaattgctgaagaaccatgacaactcaaatgtaggctccttactatagaaagcacagcagttcttgaagattctattaaatgtaaaatcttctaatttctaaaaagaataaggtcttttttttttttttgagacggagtttcactcttgttgcccaggctggaatgcaatggcacaatctcggctcaccgcaacctccgcctccagggttcaagtgattctcctgcctcagcctcccgagtagctgggattacaggcatgtgccaccacgcccagctaattttgtatttttagtagagacagggtttctccatgttggtcaggctggtctcgaactcccgacctcaggtgatccacccgcctcggccacccaaagtgctgggattacaggcgtgagccaccgtgcccagccgaataaggtctttttagagaataaaatattcattttgaaactaggaatagggtatgcatagttacatggaataattaagtagtcatgattgtttataaaagaaaggtaaattaggtgaatatagttgactaacaaaaaaagtctcgtctttcaattcttataaactacataaggctaatattttcacatactctttctttcaccagaaatcaatgtagcaaataaaaatatttgagaaatatttttaggagtaaatttggcaaagcaaagtcattctatgtttaaaagataccgaaattagtaagaataaataaaattccgaaattagtcatgttaaaagagtaaatgatataaaataatacatcagacagtgttcttatcacaataaaaaaaaggcaatataccggcacaacttatttttagcatagacaaaaactaaacaacaacaaaccaactacaaagccaattctactcaagaaaaaccctaaccagttacactgagactgtaattccaaggagctcataaaaaataaaaattgttactgctattaaatatataatcctataacctcttctcttgttttacacaagctgtaagtttttattttataaacaaaaaatatattgaaaacttaagtgaaaaagtacaagaaagactgtctccctgcatgttcagaatccaaaaaggttcttgaagcaagacctgcctcgctggcaacaaagcattgtttgcagttctgaacccacccaaccaccagaaattcaatgccctccagcatgctgcttctcaaactatcaggggtaaaggattagttctgtctgttttgtggttttttttttttttttttttttttttttttgcctttaaaaattttgaatccattacaggattacagggcaagatttttataaagttaaaaaagttagcagaaaaatgaagttttaaaaaagacatctaaaacccaagtcctaaaatattgtcaaactactagaaaagcttctaaatgcttactcttaatttctgtctttatcttgtctatggaccataatttgagtggcactgctataaaatatcagctagcaaaggacagaaaacgggtactcaatttaagatagtataagtggcaatgacctggctgtcagaagattggaagcacaactgacagaacatgtgatctaggacaagtcaccggcctttccaggcctcaaatgcaatcatttgcaagacagggaaatagggctcctcagtaacttttttcaacatagttttttcacatgactttcttcaaacacaatcttaaacagaaggccaatctgtacaacatctcaggaagctttggctgcagcggggtgggggcaacccaaagctcatgtcccaaccctcccctcaaatccccttgtaaaagcccctggggatgctagaactctatggaatccactttgaaaatcaacagctacatttttaaggtccatcacaattctagcattcattatagcctagataagtccatagcactcagtaaaaggagaaggcaaaagctttcgagaataaaattggtcttgggctgggggcgctggctcacacctgtaaacccagcactttgggaggccgaggcaggtggatcacctaagatcaggagttcgagaccagcctggccaacatggcaaaaccgcatctctactaaaaatacaaaaattagccgggtgtggtggtgcagcctgtaatcccagctacttgggaggctgagacaggagaatctcctgaacctgagaagcggaggttgcagtgagccgaagtcgtgccactgcactccggcctgggtaacagagtgagactccgctcaataaataaataaataaataaataaacaaacaaacaaacaaacaaataaaaattggtctttaacattatataatatatataattcttaacactgtcattaacctttggaatgtcagcaattggctgtcagaattgtacagccaaccaatttcttccaaaaatggtaacacagaatcaaaactgaactcccgcctcaagctgctaactgggtcctcttgaggctcacaacggctgatgatgacctcaggctgcccactcttccagctctgcgtcgtaaggtcaggaagggaccacgaggaaggggaagcaagggatgggatggtgctgcccagacctgtcaccagagtcgccaccctgctcccttcagactacggctggagacgctggagacgcagagctttgccttctccgccaacccttcccccacactgcaacccaaagaaaggtcccccttcttcctgttttcatgatgtcacagaaggaaaatctggggaggaatgttatttctgctttcctggcaagagagaaggacagaaggaaaaataagccagtgttttcctcctcttctcctgcactagaccatatgtatgtcagtttcttactatcacaaaagctcttaaaaccacttgcttcatctgtcaacaaacaaaaagccaaatctaatcctttcaggccgaacgtgtcctggtgaagctctaaccaaacaaaacagcccagcaacttccaacccttgggtgtgttggcaggccctgccctcaccctcactgctttctcatttcttctttatgagtgtcttattatgaagttatgtttgctgatctacaagacgacataaatttttactggtactaaaacaactctcaaaaagtcaggacccactttctcctttctggctcctctagaaagcagaggcaggcccaagccccgtttgaagtccttgctgccgggagatggccagtttatgtctcttgtcctaggacaggaaaaggatgcactctcggcaccatgtgctagagcgagataagaccagagattctgtcctcggcaccttatcagcttttcctgccactttccagagcagacagcaccatggctggcaatgaacgaagctagttgaaggggggttgggtgtgcgagtggcttggggactgcagggagtgaggtaggcagggtgtagaatgagaaaaggaaagagaagaggttcttcgtgtatcttaaaatggtttggtccccccaaaattgccttttttttaaaaaacacatggattttgcatctctgttggaactggagcaactaggagagatgtttttataaggacttccgttctggttagaatgaaccaccactttcattgcttcgcactctgcccgtcactgccttgtgcgactggctcctgggcacgtagcacaggatggatctgctatcagatactccgtggaaagactgcggggtccaggttgcagagcgggtgccttccacaggcacgcaagcctctatctgcacacccagcaatctcctggggccaggacacacttgctcacacgggataatccgcctcacagtgcaaaggaacaagggaggctatgggacactcctccaaatacagacgaatggcatcgatgagctgctttgttctccaacaaataacatctgtgaatccaaggattacactctttagaaaccctggtctttgggggctgggttagggagggggtgaatataactcttggaaaaaaacctagactaagcagggaaattttaacttagttatggactcagttattgataatgaactcatgaaagttcaggttgagtatcccttatttgaaatgcttaggaccagaagagtttccgatttttgatttagggatattcaacctggaatatcaatataaatatgctaaattgatattccaggttgaacatccctctcgtttttgcaaattgttgtcgatgaaaccaaatcatttgtcctgtaaagttctctcataatcagatttttgctgaatgtatccccgtggcataggttaacacatttctctgtctcatgtatctcctgtagggttcaagtgagaggcagccttactttctaacggagcacttttccaatgccagcatgttgttttatgaaaaactgggctggattcatggtctaagtaagtttgggaaacaaacctgtgctattcctccctttgattcacaatgcatatcaccatctgagacacgtggccgctgttaaacttcagaatggcccacatttatttgatcctggaaccctttttggtaaacacccactggcatcccatgaaattagtgctctgctgaacttactttgaaagggctatttaaacagatagttccattatctggataaaatgagtagttctcttgttaaatctcatagttaaatctttgttttgtcccagattgtccaagagggtgggcttttacccatgtaagtttttgcaaaaatgacaaaagcatagcagggaagtgaaaagagggcctggcaagcatcccactatggacgctagcttgcagagcgcctctgggaggagaggttagctctttcccagctatcacatgattgaaatgggaatgtctgttcctaggtttagaaaaattacgcttccattttggaatggagggtagcggagaaataacatatcctaaatgatgccaagtatggatgtattttctttgtttacttttaagactgcctacaatctagccgtattttttaaaggattatgtgtaagcagcaagccctgcagagtctgacagtgagatgaccactgtgaagaaagatcctgggcgtcaggttccacttaaaggccgtgcaaagttcaaaccacagaaccaagaataaatgtataaaataacgaagtgaataaaatatggaacacagaagtcaatggacatataacaaaatcaaattcaaaaaagcaatttctaaaagtgaaatgaaacaaacttgattctgcaactagctggtgaagagccacacaaaaagaaattccagatgactgaaaacataataatttaactgtatagactgaatgggaaatacataaagacaaaaagaactgccacacacccaaaacaaaccctctgaatctctctctctctttttttaaaatgatcaagttattggcattactctgtaactattgtgtgtataatgggaaataagcaaatgagtactgtgatattttaatgcttttatttctggaacctgttgattccaggaaacttactgtcgggaagtaaagataaaagatgagtggggttaagtacttgtggtcctaaatctaatctggcaatatgactataaactcaggatatattttatcataaagaaattatagttttatacatgtaacaaggcctacaaatgaagaccaatctaggaagaaatgaacaaccccaacgcctagactgtgtcgctaaatatcacttaccacaaagaaaggaatcagggagaaagggacgactccaagtgtggggcagaaaatgtacacagtggacctggaaactcttacactagattggaaggaagctattaaataccacttagggtcatctcaacagtactcaggtcattatctgtgtatagagataccagagatttttgtatgttgatcatgtatcctgcaactttactgcattcatttagttctaacagttttctggtagtctttggggttttctacatataggatcaggtcatctgcaaacgagataattttaatttttcctttccaattcagagatcttttatttctttttctcatctgactgctcttaatagtacttccagtactatgttgaacagaaatggcaagaatggacatccctgtcttgtaccagatcttagagggaaagctttcacacttccccccatcagttatgacactaactatgggtttttcataagtggcctttattttgttgagaaattttctttctgtacctaaattgttgagagtttttaccaataaaggatgctgaatgctttttctgtgttgactgagatgatcacgtggttttgtctttccatctgttaatataatgcattacattgactgacttacacagttaaaccagccttgcacgccaaggataaatcccaaacaaatgaaaacctagctgaaaaagaaaccaagaaaacaatcccatttatggtaccatcaaaaaaaaaaaatcaaaatacttagggataaatttaacataggaggtaaaagacctgtacactgaaaactataaaacactgatgaacgaaaaaggacacagatagatggaaagatattccatgcttatgaattaaaagaatattattaaaatgtccacatgacccaaagcaatatacagattcaatgtaatctgccaaaatcccaacggcattcttaatagaaatagaaaaaacaattctaaaatccacatggaaccacaaaagacctcgaataactgaagtaattctgagagagaaaaacaaagctggagacaccacacttcttgatgtaaaattatattacaagctatagtaattaaaacagtatggtactggcacaaaaaacagacacacagaccaatggaacaggttagagaactgaaataaatctaaacatttatagtcaactaatttttgacaagagcatgaagaagacacaatggggaaaggatagtctctttaataaatggtgctggaaaaactgggtttctcatgtaaaaaaatgaaattggaccttatcttacaacatatacaaaaatcaactcaaaatggattaaagacctaaacataagacctaaaaccattaaactcccagaagaaaacacaggagaaaagttccttgacactgcttttggcaataatgtggatatcacaccaaaagctcaggctaccaaagcaaaaatatgtaaacaggactacatcaaactaaaaagcttctgcacagcagaggaaacaatcaacacaatgaaaaggcaacctacaaattagggaaaaatacttgtagaccatgtatctgatataaagttaatatctgaaacttaaaaagaactcaagcaactcagtagcaagaaaatacataacctgattaaaaaatgggcaaagatgctggacaggtatttctcaaaagatgacatacacatgaccaaaagatgctcaacatcactaaccatcaaggaaatgtaaatcagaaccatcatgagatatcatcccacacccattaggagagttattatcaaaaagataagagataataagtgttggcaagagtgtggagaaacaggaaccctgtacactgctgatgggaatgcagattggcataccctcaaagaaaaacagtgtggaggttcccaaaggaattaaaaatacaattactgtatagcccagcaacccctcttctggaaatatacccaaagcaaatcaaatcaccttgtgaagatgcctgcagtcccatgttcaccgcagcagtttgcataatagccaagacatggaaacatcctaagtgtctgtccacaggtgaatggataaagaaactgtggtgtgtatgtatgtatacagtggaatattactcagcctttaaaaaggaggagatccagccatttgccacgacatggatgaacctagatgacactatggtaagtgaaataaaccagacaggaaagaaaaacattgcatgatctcactgataagatggaatagaaatagagagtaagataaaatgtggttactggagcagggtgggggatagaaatggggagatgtaggtcaaaggatgcaaagtagcaggtgtgtaggtccccacactgtaccttagctctctgcacttcagatctaaggtatggtgtggggactgtggctaataacagtgtactgtgtcaggaggttcactaaatgagattacacctgctcttgccatgaagggaaaatgggtaactatgtcactacatatatgtaactcataacatgtacagctttaaatatactcgataaaaaaaaaaatttttttttttaagtactcagaggccaggcgcagtggctcacgcctgtaatcctagcactttgggaggccaaggcaggcggatcatctgaggtcgggagttcaagaccaacgtggccaatatgctgaaaccccgtctctactaaaaatacaaaaattagctgggcgtggtggctcacgcctgtaatcccagccactcaggaggctgaggcagcaggatcacttgaatccaggaggcggaggttgcagtgagccgagatggtgccactacccttcaacctgggcaacaaagtgagatctgtccagataaaaaaaagtactcaggagccagactcccactgggtagaaatggaaaatttgatcaccaataaagataatagctgcaatgcattgaaacgtcaaacatttcaattcacgaacaataaaaaaaggaaaaccctccagtcatctttggagaatgctagagcacctcctcatttggaaattgctaaataaaggatataaatatttattctgtctttcctatatgcactgttcctcagagtaatctactaataaggggaaacacacattccaaatttcattctaaaaatgaaagaggaacagaaagaaatatggagggagactccatagattgcaagaaatttaaaagatatatcaaccaattgttacgtgtgacccttatttgaatcttaattccatgaaaatgtaaagaaaactgaaatttatgacatttatgaacattgagctttgaacacttattaatagtatgcaattactataaatttttatagagtataatggcactggagttatacattttaaaaaagaacctcttaacctttagagataaatactcaagtactaaaatacctgtggatgaaatagtgatttctgggatggatttgtttcaaagtaacacagaaaggagaagtgtctggagcacttacagactagccatcagtgtgtttgttgttccccaaaaggacctgtgctttcaagaacccgtgtctttgcagatatggtctttttttctctctggaaagcctctgaacctgccagttgctgctccttcaagacacatacaaaggttatcttccttgatctctgcaagctgaatccagcgctgcatcacatatgcccccagtcctctggcacagcactcaaggcctttgctccagttgactgtgaatgtcccagacttcctgatgaggttgtgaacagggattataccttacccatttaatcatctgtcatgcaataatgctactgggtagcaagaaaaacatctgagttaagtaggaaaaggaattggaggggagagggaaacaggaagaaaatgattaaagtactattactcagaactatgaaataatgagatattaccctgaagggagtcattctaagactatagccttgtgtaaagacactgagtcaattcaagcctgatcctaacattttaagacacagatgactagaaagtaggctctgtttatgaatcacttgtaacttcaactcaaagacagctgattttattcactaatgttaagaaggtgcctccacagtatgagcctaacagtggttaaagccttgtaagaatccctataaagagtctaaactaaactctgaccaatgatgataatgtgtcatgcatcatgattaatccaatttagagtatctgaggtccattaaaaaacaaaataatgtgaaagtcatgcttctgcctgtataataacacacagatctccatagcagggaggacacaggggatgagagtgaggaggctgatctaaaacgaaatgactgatttaactaaatgaataatatcactgttttactttagaaagcacatcacacattttagaagacttataagtggctctccttaggatcacaaagtaagcaggcacacaaatccaatctaaaacttttaacaatttgggaatcggaattcgatacattattttaaagctgatactctacttacaagtttcagcgctacctagaaataaaagaaaactaactgcactgattcccaaagtctactcaacaatttcctataaaagctatgttccttttagaaagggtgctgacatgaaatgttcagatttacttaggcaaagtagctttcctaagttagcttttctgcttgcagaaaaataaacctcacaaaacctagtttactgaaaggcataaagtaagtttaagcacttgttaaaaagctatttggagttcaggcccacaaaatgcttcaaaaccagtcaggtaaaatttaaaacctccatgtgattttaagagtcagaacgtgaattaaaggagcctggactaaagttaggggacagaggtgactgaaggggggatgtcattaatgctagtactttgcttaaagcaagcctttttgatgcagaaaagataaacttgtcaaagaacaacagatgacaaatcaaagactaaagcatttcagcctcgtgctctttggcagagactgcccgctgttcgaagacatgcaaactctgagtgaacttcctagaggctcaggtggcttcagaaaagaattaacagaaccttcagaaacagaaaaacctaccagcactctgatccctaataaacataaagagcgtatcatttaaatcttaccaaggaaaaaaacttctttttagaaaattcccataacgttttaagctagttcaagattgtgttttaaacagaaatttctggttgttacaaagtagttccaatggaattatataagattacaatttaaagacagataagcatcaagagatattctaaactacacttacagctattaaggaaatcctactaacttcaagctaagtttaagctgcttcttgcattattctatggaaggattggcgtagcaagttaacccatcagaatcttattttaatactttactttagaaccagtctacgaaaagataagattcttagactccatccaatcatgcttcggtgataaattatccaaatgacttaattataaacagtttgaattacaaagaactcctaaggcacaggaaaatgtttatttaaattactataaaaaacactttcaggtagcttcaagcaataggatagcactcacttatacaaacatttgttgtactaattacaattagttcttattatagcaatcccactgggacagtttgaacaataagctggggttgaagctgttttttcctctagaacaaaagttctcaaaccccaaactcaaataagaaagatcttaaatacaaatgcttttcacaacactgaactaacttgtgtggaaagaccgatttttaagtacccagtatgtggaggtctgttgcttgtgtatgtataccaacatatacgtgtgtacaggaccccactccatgtaaggaacaaacactacatactctaatggaacacaaatagtgtactgagaatagttcttttctctttagctagacaagtgtttaggtttgttaccctgaaaatcaaattaaagatggaaggattagctacctgaaaagattctggactgcgtatatcactaccagattaagggagtttatgtggcgagcgcagagctagaccacggtgagtaaaagggaggcagtcactttcctcactgaggacatccaggttgtatgtggatccactagtgcctttggtttataatccttcatttttcacattttcatcgattcaaaatgccttgttatcttaaaaaattattcttaatcatttgttcacttccttgccaatatatttaaagagacgttacattttaggtgaatttcttgggactgacaaacctgataattgaacatcagagttaggtctataaacggcatcaataccttcctgaagccaatacaaaagtgaagaggccttcctattctcttgcatggttggctctttctacaacaccaagtagcgtggctgtcttggtaaacaggggaatggtgccagtaaaagtggggagttgcacggttcaaacgtgacatttcctaagcaaggggagccaagacagtgtgagcagaactataaccctgagaaagaaagaaaaagtcccaagtctcagcgtggctgcagcataggcaggacccctccagcctactttaggaaaattaagcgtgagctacgccccagaagggctcaccccacagggttggaccctgtgactggtcaatgcaggggcacaaagactctgccccctccaaagatctggggcagttgggaagagctccctgtggagtcagctgaaaacttcagtgtatactgcaggccaaatcctctccctgtgtaatcttgcttcctccctcttgctcccccagaaagcagtcctgaaagcactcctaggaactttctgcaggccaactcccaggaaccaacctgcaaactgcacttgcacccagcgcctctccccagacagccctcagctagtggcagattgcaccccactgtggacccctaatggggagcatgtctattcgactgtctttgaacatttttaagactcccaagtagccccccgatctcagtgaattatctcatgagggaacaattactgtgtgtgtggaggggtaggcaacaagtattctggttgtaaaacgacatacattttaacagtttgactcttacccaatttttcccatgagctctgttatttttatatttttgtaaaatatttttcatgaatgcataaatagcagaaatgtctatatttgatatattatatatataaatgtatttacatatatatacacacatacacatattttatgcacacacacacacacgtttgtttgttttttttccaagagacagagtcttgctttatcaccaggctggagagcagtggcgcaaacacagctcactgtagcctcgaattcctgggctcaagcaatcctcccaccacagccccccaaggagctgggactataagtgcatggaccaccacactcagctaatttttaaattttttgtagaaatgggatcttgctaggttgcccgggctggtctccaactcctgggctcaagcaatcccgcttcagcctcccaaagtgctgggattacaggcgtgagctaccatgcttggctgacatatcttctatttgacattagtattttgaaagagtttacaatattattatctttcagattacactgtaagctatgtgatggcaagaaccatttaccttttggtaaaaagccacacaagggaaattaaggataaatgtggattcagcagggatggtaatctatgtggttaaagtgagtcagtgtacggtctctttacgaagtgaatacattaaagcccactgggaaggtgaaatcaacaaaattcaggacatgggaaattctgtaagacaaggaatccaaggtgacttcaacaataaactgcaaagaaaaaagagagaaggaatgagaacctattggttaagaaagtctgaaagacattatcaattaatctataatatacagaccttgttagattcaaatacatattcaaagtaaaaagttattagacaactggggaaacttgaacattgactggatttgatgatactgagaaactgtggttaatgttttttggtgtgataacagtactgtgactgtgtgttatggagtccttatcttttagatatataatacatacagataggatgatgtgatgtgtaggaattgcttcagtaatgggaaagaggggtgggagtacagctggaatgaggctggccacgaattgatcattgttaagctgggtactgggcacagacagactcctttattattctctctacttttatacacatgtaaagttctccataagcaacagttttaaaaagtgaatgtaggctagacacagtggctcacatctgtaatcccagcactctgggaggccaaggcaggcagatcacatgaggccaggagttggagaccagcagttgaagacatggtgaaactttgtctctattaaaaatacaaaaaaatcagctgggcatggtggcatgtgcctgcaatcccagctgctcaggaggctgaggcaagagaatcgcttgaaaccgggaggtggagggtgcagtgagccaagatcgtgccactgcactctaccttggaagacagagcaagacactgtctcaaaaaaaaaacaggaaaaaaaagtgaatgtatatctattggtataatatcattagagttcttcctggagtacagtaagtaacctaaggcatctgtgtctaagtgaaagtggtcacagaaagtggcctacctgaagcctggcagttccattatcctaggagaaatcatcgtggactcttgcagaaaaacaaggctgagaggaagccaaccaaggcagaaaggtgaccccatctgtgcgctgactcagacagcaaagcggtgggtttcccttatgagatcatggattggccgccagagaccgctactaatgttagaacagggtttttccctgaaagagtcacaattcctctccctggcaaaacaggaactggtcctaacaggaatattatgtaataccagaactgaggagctcaggaaaagcaggatgagggtgggggtggggattgaagagcagagccctttgtgggagcgtgaaagggacaagcccagtaccggcttcctgccagcctccccttccctcctgctgcagcgccttccctcacgggatgagcaggcatctcataggcagacagaacatggagcaggaataaaagactcccaccttctccaaggctgacggtaactgaccatgtaactacagtgtaactgaggggaccctgcatagacagaagatgggccagcgagatgaggagccatgctggacgagcatcctttttttccagatgtaataaggtataagtgacagaggaagactctatgtttaaggtgtgccatgtgatgttttgacctacatatacatagcaaaatgatccccacagtcaagctaattaacacatgcatcacttctcacagttacctttgggagtgatgaggacacctaagatctaatctattagcaaatttcgagtacacagtgtgttcttattaactgtggtcaacatactgtatgctaggtctccagaacttactcatcttagcctctgtccagaggggagctcccttgcaatgtagacagggcagtggtcagaggagtagcattttaggaatgtcctcaaatagcacagggaccataaacaacacatgtcacaggcccagtggcagagccaaaaacgcaagctgctaaagagacaaaacgtgttcaattgtttttcaagttcagtattgtccgtatccgatgaccctgcttttgagacagacaggaagggtacacaccactgagaccacacacacacacctccacgtgcccagcttttcactgtggttatctctggctgtttggatcatggatttttcccccttcttcctaatgtactatgtacaggtcatggtttctctagagtggacaggtactgcttttataatttaaaaatatttgaaattaaaaactcacaccgaaaaaaccctacaagcctagggcagagtgctctctctgtgaggacaactgcattcaggaggccaggatgctgtcacagccaagcggcaggtcctgaccctcatctcgacaagacacaggtggaggcgccgtctgcactcactctcaggactcaggttccctcctcatccctttcccttccagaaggtccccatgcttctctcaaggttcctccccaactacaccccaccggcttgtgtctgtaagcgatctaacggggctgaataaaaaagtcttccagcacagcaaatgacagaaaaagtgttcaaatgagaacaaaagaggcttttcaggaagtcacaactcgatggcagagaaggctctgacatgcactgatgagtacatgaaagaagtgaaggacctcacagcatcaggtcagatgtggaggaaaagttaacagcacgagcgatgagatgacaggcaagccagggggaggaagcaagggtgagccagcagaggcttcacatccagagctgctcccatctgcacgtctgccctgccgtgcgctcctctcccaggagccgtgtcaccatccatccaagctgtcggagcctcaactggtccatactgtcagcccccaatcccagggcctcgacctcccaacatgactccaccaagctgcccctttctctttgggtcttgccaccactgagcagctcaggctgaggctcaggctcgggctctggcatcctctggaacagcgacctctacctgcctgcctcagtctggcccctccttgccctcttcattcttagtgctttatctctgctgctaaagggatctttctaaaatgcaaaagcaaccagccccgtcccatacttcaaagccccagaagctctcaagtacacgcaaaacaaacagtctatactccctgcagatgtctaatgggggctctcagggaaaaaaaaatccccctccctcccccagtttttattgagacagagtatcccaccgttgcctcggctggagtacaaaggcgcaatcttggctcactgcagcctccgcttcccaagttcatgtgattctcctgcctcagcctcccgagtaactgggattacaagtgcgcaccaccacacctggctaattttttgtatttttagtagagatggggtttcactatgttggccagtctggtcttgaattcctgacctcgtgatctgcctgcctcagccttccaaagtgctgggatgacaggcatgagccatcatgcccagccaaaatcccccctttttagatcctcagcttatttttcaacacccaccagaaaagtcaaaattaattcataacaagactctgtttttcaacatccagctgcagctaaagcatctgaagcctctagtgactcccgtccctcctcggtggaagcacacatcgcaaatgctcagtacacagcatccttgggtcactgcaggcacagtatgaagtgaccagcttagggatggcagctgctccaggctcctggccgtgacgagggctgaggggatcaacccctcggaccaccaacaatccacttgtggcatgccagctggtaaactccaactgagaataaaggggactgttgaaacctgcttgtgaagctacaattagaatttaggcttcagtgcaaagttggaaacatagctatattcttttaaaaggactggtgggttattttggtttggggagctccagcccccatctttgtggcggctgctgatgtgcttgggcgatctgctggccccctggctttctagagagagtctgactacaaactataaaccctggaagagacgccagggtggtggcggcaacctctctccagcactgcgcgaggcaaaggacttgcatttggcctgtggtgctgccgcggttcctgcctgggagcggggagacatcctgccctcttccaggttgacaagaagcgtgcagcttttgaaggccctgagacccccaggacaacatgccccatctcagtctctccacagaggtgccagttacacctggcagtgatgagactcttaactctccgtgctggccaggaccgccccctctctcccgctcaggaccagcaagggtagcgctggagcttgtctgtattacgatcagctattggagtctgagtctctggataaaggtccagctatttagagacctagagaattatcctctcattggatgacagcaggccccgcagatgcgctggcctcgctctccctgcactctccgcgctggatgggcctgcagctgcaggttcctctctgccctctttccacttcacgtccgcacccactgctacttctgcttgaaaatcctcctgcatcttctcttactgacccttttgtcctttatggactagcaaggacaacacctcctccaggagggcaggaacccacctgagagggagatgccccgggggccacgtgcacaccttgcctccagctcaacagttaaccaaaccgcatcaaaatcattgaccgtccctcccccgtgacgctgtgcgctccctgaagggacagactgtgcctcttcttcacagtccatggttaagagcgcctggcacccgccatcactcaggagtggttctgggagaaacagatgaagtaaagcagtttacaacaaacagaaatactctcaggaatggaattcatgaaaggcttgcagatggtacaccacatacacgccgccggtactctggcaaaggtatttttagcatcttgagattaaatggttgtatctataggtgactgtaataggaaaaaaagaactacttcagggacacgattaattgctgtgatgtgataaacagcagtctacattgtattcctcatggcatagctgtcacctgtgtgaattacttagctcataatgtttactatgttagttagtgtgagtatacacaatacaccatctcattatctgagatgcccccttacctctcccagtcaagcagctttcatttccaggtggaagctgaccgcacactgcacctcagcccttgtccagactgtcttgttgccacttccatggatttgctagatcctgctccaaatgaacgtgtttcccggcgtgccattctgaccctcgctaacatctactgagtgcctactatgcgcgaacactctgctaggggtagatacacatgatgacgaaagcatgatcttccgcttgaggtgcttcaagaagtgtaagcttgaagagctcctgcccccaagtctgtaactcctagtgtctgcatcctctaaactattttaacaagcatattatctacataatgctcaattaactggtctacaaaccaaattattattgacaagttcttctgagccaagagttatgctcctgagcttagtttgcccaaatgttttcacctagaccaggggtgtccaatcttttggcttcccagggccacgctggaagaagaagaattgtcttgggccatccataaaatgcactaacactaatgacagctgatgtgctatttaaaaaaaattgcaaaaatatctcacaacatttaaaagactttacgaatttgtgttgggccacattcaaagccgccctgggcagcatgcagcccacccgccatgggctggacaagcttgacctagaccattacctttctaccaaaaagcttctaaggaattaatgctaaagaaaggacacagacgtccgctggaacgggggcatttgttttaattttaattattaaaggtcattaatttcaatagccagaaaaaaaaaaagaccttacttgaaaaacaaaagtatagtgaatttacaaaccattttgcctcagggatctctgtcaaagcagcaacatgaatacacttaatgctgttgtaacaaatcatgacaacatgagtcactgaggagcctcttagtatattccttatgacctgtacagatttaactcaagataaacttcaaacaaatattgcaatgagtatctagtaacagattcaaagaggcgacaaaataattccactggggtgtgtaaaagctacgctgctcaacatagcatttgtgtgagaagataactacattcaaagatcaggaatgtttttaaatttgaacaaatgtaaactgttttaaaaaatggacttgctagttgctaagcaggtgtcgtcaccagaataactctcttcattaatttttctcttcaaaagtgagaacgttatgaagtggcagtgaaggggtatttttagaaatgggctcagatgaaccaaaatattaatgctcaatcactggtaatctatcacgattaaaattttaaattacaattttttaaaaataaaattttaaattacatttaaaacatacagatcttaaaatttcaaatatttccgttaacctacacagaaaagtaacttttgtttattcacaaaaagtagcttcatcatatattgacttaaaatatccgaacagtattacaaagtaaaaaggagcaaacccttcgcctgttgctaccttttttttttttgagacggagtttcgctcttcttgcccaggctggagtgcactagcgcaatctcagctcactgcaacacctccgccttctggtttcaagtgattctcctgccaagtagctgggattacaggcgcctgccaccacgtctggctaatttttgtatttttagtagagacggggtttcaccatgttgaccaggctgatctcgaactcctgaccttgtgatccgtccgatcacgaggcttcccaaagtgctgggattacgggcatgagccactgcgctcagctgctgttactacttttaaatgagtgggaagatgcgttcaaattagacttttacgggtttaaaactaaaatccgagtgcatgtatgtttttaagattccattttgtttttagtgacatcaatataacaagtgctctgaattcctcccaggaacagaaagaccatttatctactgtatttattcagggcaagcttcccatctgtgtcagactgagagatttaacattgctgaagaatgcaggtggtgataaaggagggtgacgctagaaatgaacacctcacgtttccaaatacttttaaaaaggacaaatattatactcatctagaaagtgggtatgcattcagagaatcagaagacaaaatccaaaagcttcttgactttataaatgcaaaattctaagattaattcattcaaaaaacaaatcacttggttgggtgaaaatcctaatatcgaagtaagaaaattcaccaaatctccagggctaaggattatcaaacctctgcctctgccaagttcagttcatagcaatgtctttgacctggctacaaacagagggcttggcttgctcccaggctgtctttcttagctgctctaatcaatgaagcagaaagggtcctttctaaagatgccagcaaaatttttaacaatcaacgtcaccttaagtaaaaattaaaagtctctctcccccacaccaagacggagtgttgctctgtcgcccaggctggagtgcggtggcgcgatctcggctcagtgcaatctccgcctcccggattcaagtgattctcctgcctcagcatcccaagtagctgggactacaggcacacactaccatgcctggctaatttttgtattcttagtaaagatggggtttcaccatgttggccaggctggtctcgaactcttgacctcgtgatccacctgcctcagcccaataaaagtctttaacttgtgactttatgacttatttttatagtcactgcttgtaagaaaaaatcccaagactctcaaagcatactgtattacctaaataggtaaagtcaaaagtaaagtgatctcactttttaaaccaaaatctctgttacggaatgccaagtattatgacagttagcaaaaaacaacaaaaaggccctattcacaaatcccatttgatttttttttttcatgatgcctaagcttctgtcccattcaactgaacaaagctttgtatggatgaataaaacagagccattgctttagttgcctaaaggtggtttaagacaaactattatcgtcacagaagaaaggtacaggtgtttcaaaaagcgaactggctgatgactttgcaggccaagtggtgaaagagcttagagatttggagaaccagtcagttcaaatgataacgggatgggagattctgaaaagcgcagataatgacttagaagagcacagagaatatctgctgagtgcatggaaggagcttgattggctcagataagagaggcttccaagggactgtgagcaaaacccaagaaacagggcagcttgggggaaaagaacttccatctgaagtcaaagactccaggcatgcgaaaggcacaggatccccggggggaaatggacaataaaagaggtgcgatttgtttaatttcaaccagagtagagacacccgcaagaatccgatgagttccatttctacctctcgtatccagcctttaccattaagactcactcagccatcagctcccccttccagagagcagcttgggaaagggaatgaagaactctctatgagaggaggactgagctggccaggcatgccttccgggctgctgttctctttgtttagttctattctgataatagatttcctttaaaagatacaatgtttaaaatatgggaagtcctagaaaacaaacttgctcactccagacaggtgataagaatccattactctgcccacattttttatctgcgattttttccccttagtaaccttgtgtagctttcctcaacttatactaagagctgttaaaaaaaaaaagggttccagtcaaaaaagtaacattaagttttagagatgaaccatgttcattaccatataaaaggctctaagaaggatgcaatgaaaaaaattgttaaatatctacatgtttaatctgtgtttcccaaatgtatctgagcatgtgacaatgacaactatcagcactcccctcctcccaacccaaacatctaccagcaacactgatggttccaaggaacacattttgggaaactctgccctacagcaatgctgacagtaagaaccaagcagaagaaacagccccacagcttgaatggaagctgatccactctctgtctcccctacccagtaacacacgtgaacctccagtacagtaaagcgggtgacggagagtgttgctgccgtggagggagaagggcctggtttttcagcaggggtcttcacgctcactagtctgagtcttcagccaggttactttaacctttgtcagcttcctcatgagtagttcctacctctcagggttggtgtttcagggacctagaaggaaacagtgtttcaaccgcactctaaaaaccaaaagctccctcaaatacaaggcattactgttgttagtaagccactgactgtgtgacagaaagggtgtgctggaagacacttctactgcacttagctcaagcctgctagcagagcctcaaacagtcaacagtggcctctcctgatctcaaagttttgaacacatggttataggagacaatattgttgtttaaaacaaaaaaacagaaacaactttctaaaaacaaacagggcctaagtcatgtagattactgcagcttcaggaatatatgtaagccactattttattcaaaataaaaagaggacccctgaatcagattcagaagaaacctaagcattgaggaccaccaggggtgcctgaaattcactttatttctagcacttcatcatcacagcaaaagatgcctcaaaccaccttttcataccttcatataatttgaagagaaagaaaacagcttattttcagtcacagagatgtattaactcataattcaaaataatttattcaaaaatttgaattaggaaatggtacagcaggaactagtgacctctccactgtctgatggagagaagaaatctacactaacacaaccatgtcaggagaatctcagccatctaccaatgcatgcaggtgggacattctaaatgatgagctaaacagtccttactacttcactctatcagaaataaagcaagtattcttaaagaaaataatgaagtactgaactgacttttcaggagtaacagctacactagaagtgaggaatagacggggagacagattccatcctggaactgccccatccacacacatgtttctgggatgtttgtaggacacgggtaggctgcctttgaataaactgctcagccaacatttttgaaaacttaactgcatttcttttagagtccatgtggcctgggtaatgcttattaaatgcccactgaagtgtgcgtgtatgcatactcacatgtgtgctgctgaaataatgagagcagcacaggctccagccttgagaaattattacttcaagttgacttccaggccctcccaaatccatttccctcaaacgtaattggaaacaaatcagaatgagactgtggcaacatattatttttaccagtttttaactagcacatgatttcagaagtcaatatgaagttacacttccacttgatatatataaaagaaaatataacagtggaaattactaaagaagagaaaaataacttctttttatcagtcaaacatgtagccaggactcctggggaaaaaaagccaaccaggcaattcaaaagctgcaccgatggccgtttaggaaagtctcttggcagtaagccaggtaaaactaaactctttccatctcctcctcaattacttttgcaactctctcaaaaggtagagacaccttttctaaattcagaaaaggtgaattattttcagtctaatggcctggtcactgtttctgaaattacataccatattacctgggagcttgttaagaatgctgatttctagtgtcgagccagagcctacaatatgcatttctaataagtccaccgggtgattctgccagcttagaactggaggcggtgaatcaattactgcttagtagctcctcctggtgttagtttttcagaaaataatcagttttcccaaattgtgcacaagcagcaatgatttgatattagaaaaatgagtttgtactcacgtacactttcacagcaaggaaattagaggtaagaacccttcctactttcttgggaaactgatcatctgtattataatatttaaattttatttcaataaaacacagtatttaaaaaaaggttttctagtttgtcaattttttttttcagtgtatttggaatctatatctggacagagtacctgcaaaaagtaacagattcacttaaataattttattataaacataaacttatgttttatgctgttaactatatttgaatacaatcatcaatttaagatggtctcaacagaactgttgagactttaaagggtgtgttcatgcttcacgtgtttgctgttgcttttacaagcgaacagttctccttgaggccccgaggcctgacagttgctggggaaatgatgggacagacgtgtctgctcctgtttccatccttcttctgcctggctctgccatttctcttactctgcattctagacctgccaccaaagattccagttcattccccaacacacctgcttggcttatggaggtccaacttcaatacgctttgaaatggacaggtgagcggcctgactgggagaaagcattcgggcaaaagtggagccactcagaccacattggtgaccactccacagcagtctaatcccacttactgtccctctctaaactggggtgcagtagacagaaccacaatccctgcatgtctgagtgacgggacatgacacagggccattaggtaagaggagccgctggcaggggatcaagggaggacaatgtccaaggactacagactagaacatggatgctgggaattttactgggcaaagtaggttttttccaagttagggccacttccaacaaagctgaatagggaacatgttctcaaccacggtctgagttagtccttactgggctatttgtcattccactagctgactgctaaggctcagaaaggttaaattcctgccaaaggtcatatgactcacaagggcagagccgagactgcgatccaggtctgcgtgatgacacatcccggactctttctactacaccacaccattcttgcatctgttactgctagtctttaggattgttttccttctcagttttgatggaaataacattttttctatctccactgtcacttccacaaagtgagaccttgggtgcaggaatattacctaacaagagtctgatgtacagcatttggtattattcttaaggattcatgaacaagaacactgcgtatgtataaatgaacttgtccgacttaagagtcaacctgttgctaaacgacactgatgcaatcagatgttaccgcagagttttaaataatgtcaatgataattattttgcgattcttttactgaaagagctgttataagtaacttgggttcttcttggtcatgatcattctaaaacaatagaatggagtttatttacatgatctgactgagaataaactttttttttttttttttgagagcaagtctcactctgttgcccaggctggagtgcagtggcgtgatctcagctcactgcagcctccgccttctgggttcaagcaattctcctacctcagcctcctgaatagctgggattacaggtgcacaccaccacacccagttaatgtttgcatttttagtagagatggggtttcaccacattggccaggctggtcttgaactcctgacctcaagtgatctgcctgcctccgcctcccaaagtgctgggattaccggcctaagtcactacgcccggccaagaataaagtaaaatttcttaatgttacactagccccaaatgaaaaaggacagcactctcttctctttgctttcccacctcagaccataccacttgatccaggcgctcagcttacaggacccaaatactgaagcatgcagatgacaaatctgtcccaactctcctttctgcaagatggacactgagtcagtgtgagatggcggcccctgggggagtccctggcatcagtctcttcagctttctctattttcttaatagatggataatggagtagaagctctatattttatcatgatctcagcaagataaagaggaatatattttaggaagacactgctggtagaaaaccgaattccagaacacaaaaacctcagtgaactcttcttcccagtaccacagattaatcacgcctatcctgcagaaagggaaggaagggggaagtgaatagaggaaagggatggatttccaatgatggcttacgaaagcgtgcttccaactcccctcccatatgctaaaggaggagaggatgatggtgccccagctatctgcttagacttacttcctccaagaaaatgatgactgcacatttgctttatgccttaaagagtctccaagtactttcaatccatacaatttcatcaactgctaaagtgagcataggctgtcatccacatttcccaagtgaggaggaagaagatcagagcaggtatggtgtggtcccctcgcctagaagcaaaaagctggaattctctctgcccagctctgaagtgggcaagcttaacctctataaacctcagtttccttttctggaagtccagggaagacctagatggtcttttccagctataaaatttccagtgtgatccaaagtcacactgagggctcagtgacagagctgggacttgagcctaagtttctgacttttaaagcaatcagaccttacagaactacagcaaaccacctctaatgaaaaagaatttgtggtatcattctaacctggctcctggatgctttaaacctgtgagcaatatctcaagaatccagactgccaggagaacagatttgcctaaaagataaaggaacctccatcgctgaccacgggtatcgtcctggccccatgagagagcttgtcacaggaagtgtcaaggaaaacatgaaatgcacaagcaccactggaatgcagcaatctcacagtactgccccatccccgcaatggagaagcagaagatgcaatgcatgccgtacaagtgccagctacatcctactgacaaactggaagatgtacaaagaagaaaaagcaaagggcccaaatgattcaaagaaatgaacaagttaaaaaggtagtttgggggacggaagagcaaagggaaaaaaaaactttagcataatcaagaacttccttggaataagtcgaaaagcctgcagcattcaatgccagggaactccctcccctggaacagagaattgctttagggggaagctcacaaggctgaccgcacctggggaacaattgccaaggagacaaacttctgtgacttacacacagcaggtcactcatacactgatacactcatgacattcccttggagcacttcaccccacagacaagaacaaggttgacgtgtatgaagacaacctgcactctggagacatcaatcaaatttggatatcccaggcctggaatagctttgtactccactccatcatcttatgatttaaaaattactttttgggcttgctcccattctgaaactcctatctctttgccagaatccagtatcaacaaaaacctattggttactctgcattcctaaatcttcctaactgcttgctactctcaaccttgatttccccactagccaggagtacacagagggcaggggcccggtggaaccaggcactctactgcttctacacctcacttcggtcccatgggatctgggcgaagatctctatgaagggaatgtaccagacctccagggtgggggatggggtgctctgctcagaggactggggaattatattccagtaaagaaccaagatatggattctcctgggacaactatctttcttctctttgtttgcttccagccctgacttctactaatattagtatacacagcaagaagacttattgaaaggatttaaggaagaaataaactaggacatatgagggcaaaaataaattggacactagcaacttcacacttgcaggatgaccatgacattgtgaacttcaatgtcacacaaaattaaaccattctgtggtgggactaaataaatattaaagaacatattattagtagattaaaaaaacttttttattgtgcaaaaaatttcaaatatacaaaaaaaattagtgaaccctaatattcctatcaacaattaacaaagtttgccacattgttacatcattgctttgttctttgctgaaatattttaaggtgaatcccagacatcaagtcatttcatcctgaatgctgcagtaaaaaccactaaaaagtacggaaatttccttacacaatcacagtgccattagcacatctaatcaaacagacaataatttcttggcatctaatgcgatctatcatcagtttcctcaccagctcatggacgtctttttatggttcaaatcagctcttaaataaagcctacactagcgcatgatacttgtatcttttagggtttttctagttaccacaccctattctttcccacaatcccatatttttttcattccactgacttattgtagaaattgggtcaattgtttcgagctctgtcccacattctggatttttgtttgtttccttctaagattgcatctctataacttatattttctgtgaatgaaaaatacttctagagatttgattagatttaggttcagctttttggcaggaagagttcagatttatactgcattatgtcaggagcacacaaggtctgcttgttctacttccgtggtactaaggctgaaccataaatagtaggttctttattagactgaaaaatactctttttctgttgaaaacagatttactatgaaagtgaattttgtataactcttagtatagtggataatgtgtctggattttagtaggaaggagaaacttaattctttcatagggctatcaattaagaagcaaggaaatcaacctgcaatgtaaaactacccttgattcccatgagtattaaagaagttcaaattagctatcattttaactataccaacgaactcatatagttacctagttacctagtgagcaactactaacgaccctgagccagggcctatgaaagtacaaagccatggcctctgtcatatgggcagaagaggaagacacacactgttgaaaggacagcatgccaggcagcagacagtaatcagcaaattcagaccaacgcagagcgcagtgagaggcaggatggagatgaggaaactttccatgaagatgtcactgcggtgttagccgccgggggcagtgactctcatcaccagagcctagaacagtacctagcacagaagaatttaataaaaacctgccaaataaaacaatgagccagaacgtgctcaggggcctgaaagaggcagcagcagagtgggtgacacagagctgggtgagaagagccccgggaggtccgtaccaggagccagcaagcatcggcatcagggaagcagattagcgtgagctgggcaagggtctggtgtgtgtgttaagggagctgcatctgtcatacgctgggcactgctgacatgggacagcagcattggagaagagccgattttgagaataagctctcaaaacgctctgaaaggatgccctgcaagtaggaaacactggggccggggaggctacttaggattacaatttaggggtcataatgattaggaatggtttcatcggaaggaatgaaaaagcaagatgaatgctggaggattaaaaatacaaaattagcaggccctggtaatgtcaaaagaaaaaaaaagaaatcacagatcacactcaagatccaacaactctagctaagtaagatatccaattattaaaaatgtgcttagtgcttgtactttgtcccccacaaccctgggtatgggtttaatctactcaacatcattctcatatgaagtgaccctgcctatactttaatcaaaaactcaagaaggacccccgagaagacttggtttgacgctacaaagggagttcacacctcggaatgaagtgaagactggtggcactcagctcattcctcttttctcttccacatcacaaatacagtttccactaatctttcccaataggacaattattattactaagaaaggcaaatgcaataggtgaggcctgtctctcctggcagaacacctcacattctttctgtgggaaaggaaaatggagccaggggcaagttacctgacctgctgcgacctcctgcagggcgtgcttggaggaaccatccagcacagacagcctgctggctacaggaggcacacgcaaaagacatccacgtcagggtaataacaaccagcatgtatttatggaggttcagagcactttctgcaacccaccccatgtttcagtaagataagttaggaatggcatatttccatgatacactttagacaaccagagtactcgaagattgatgcttaacttgcaggaagaagccatactagtgctgagtgggtggcagagcacaggaagaagccacactagtgctgagtgggtgacagagcacaggaaggggccacactagtgctgagggaggaggcagagcacaggaaggggccacactagtgctgagggggtgacagagcacaggaaggggccacactagcgctgagtgggtgacggagcacaggaaggggccacactagcgctgagtgggtgacggagcacaggaaggggccacactagtgctgagtgggtgacggagcacaggaaggggccacactagcgctgagtgggtgacggagcacaggaaggggccacactagtgctgagtgggtggcagagcacaggaagaagccacactagtgctgagggggtgacagagcacaggaaggggccacactagcgctgagtgggtgacggagcacaggaaggggccacactagtgctgagggggtgacagagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagggggtgacggagcacaggaaggggccacactagtgctgagggggtgacggagcacaggaaggggccacactagtgctgagggaggaggcagagcaccatctccttcactgcacagtgggggctttctcaaccttcttcaggcttggatccaacaagctgcagtaggagctcatggacgcacgtgtgggggagaggtctccatgacaccacggccgtacttaaatacaactcataaggaagtaaatctgaggagcaaacagagtaagtttttgtgttttctgtttgtgttttaaaatgggaatgatgccaggtctaagatttgaaaaatgcaaccattcccacccccctcacatgtattgagaggaaacagtttataacattgtggaaatgatggatgagaaaagggtttgttacacttttgaattgaaagggttttctcttagtctttctccactcctttccttcaataacgatttgctgaataccctgagcctaatggcccaaccactttccagagtggggaacagcagccagtgtttcctctacaagagaaacatgtgagggaacagaaggtataacccctggaaaaactgacccccagaggctctgccggcaggccctaggatgcagcggagggcaggggaggcgctcctgacaggagggaggccagggcatgtaggaggacctccccactagtccaccagagcccacgtccatggccccagcgagagggcttctctagagaagccaagccccagtgacagaaagacccgccaactctgacatctgggggttccctaaggaaatggcaaactccccatctgagaaggctgcctctgcaaacagcttccaaatggctcttcattaattgactgttaaattacagcagacggcaaaggatcatcggactatgtgggggaaatcctccctcatgaagggagcaaaccaaaaccaaaagaaaagaggaactcagaggaccaagacaggaaaacaatctgcgaatgtgtgaaaaacacaatgcctccagaggccaaggaacatacggttgtatccgtgagacaagaacaggacattattaaaaaataacaatgagatagtaagacatagctcttgaaaattaaaaatatgacagcaaaacttaccttataataagaaggttggaaaataaaaatcaagaaaatcccccccccacccccccccccaccaaagtagaacaaagatacagtaaaattggagacaaaagaaaaatctgaggaggaattcaagatgtcagtgcttcaactactggcttcctgacaaaacagaggggaaaaaattatgaaacagctaatgttccagaactcatgaaaggatatgaatcttcatactgaaagttctaccaagtgcctggtgaataaaaacgcccaaccaactcattcccatagggttttagaatctgagcatgttaagattctaaaaccttctgaaaatgagataaacaggtctgtgctaaggactaaaataagaactgcaacaatggctatcagaagacactagagtaataccttcaaaatgctgaaggaaaatgattttcaactcagaattctatacccagaccatctgccacagtattaatagagattttcagacctgtgcccttttcagaaagctgtggaagatgagtgaggacacagaggagctaaaaggagcaaggctggggaaaagtccaggaggccagggaaatggccgagccagcacctagtcctgagggagccgggaggtggaaatcttaagagagaggtctcctgggagacagatccagctgacagatgatctgatgcagctgacacactgaaagttttatattaagaggctaccaaagagtctagagggaaaaaacaaaatcacacagatatacagaatgcttttgtttcccatcagaaaacaaccaaaaattgttacaggaaatgttattattgtacactatttggcttagcagggtacgatatttacatagcaataaaaatataaaccccaaataacaaattcactaatcattatacaatacaatcagtagtttgagtggtgtaaaggcccagatcttaatctaccaaaacagaagtccacattttaaaaattatgacatggaaaaatgtcaatgcaagttattattgtaaaatatgaaggtaaataccaaataactgaggaagaattgaaagtgctgtagggaggaggcttgtgaggtggagtggcaaggatgactacagaatgctctttctttaaaagctgtttggcggagcttaatttttttacatctaggtgcgtatattactttgattaaaaaataacaagcatttaacacataatcgctatctatgagtcattgttcaaatgcttaatgtgatctcatttaattctgacaacagtcctaatagatgatgttactattatccctgttttaagatacaaaaattaaagtacagagaggttacatagcgtgtccagtagcgcagtgctagcaactgatagagccaagattttaactcacgcaatgtggaccagaagctggagatcttaactcggaaggaagccaggaaaagataatttcatcttgggaaaaacaatctgattttcacctattggtaaacctagatagtcaaaaccaatcggcctatctgacatgaataagtaggaagcatttattttctcatatctaaactcctatatttttctatcaacaacacaaaaacacagcctaaaaagcaagagcagcagaaaaggaaaagttggaaaaaaaactgcagtcacacaaactgtagttaaaaaatgactaagtttccttgatatatgaatttgttggaaaaccatttatcaacagcctgtttctctctagcagagtccctcaagccgagagccatgtcattcccctttgactgattaattagccaatcagaggacatttttcattgtgaggtatgatggtttatttcagctaatgtttggtctctaatggcgacacattaaagccaactcggctattttagccctgtggagtgaccaaaaggaaagaacagaagataaatcaaaagagctcccttcagttccccttcagtccttaacaaaacccctaaggagcaagtggctggagggaagatcctctaccaataaagagaaagaacaaataaaagaaaggcacacatgtcttcaagcgaaagagtagccttcctgtttctgaagagcaataatttatctgttgatttacagaccactgacagaacaggccccaaaagtcaatatttagctcttcttccttttatcaaaagctgtgctcaatagaaaatatagctctgtaatgcttcttactcacagggctcattttccctgcactctgaattagaagaggctgtgagtaacccatctcaagcactattcacaccaaagtcactccagccagccaatatcccactgcactgtgggttctctaagcttcttacctgttcctatgctgtgagggcactgaaaacacaaagaagtgaagttcaagaggaggacagataggaacattcacacatccaggacaagaagcacatcttcaacatgtccactgacagcacactcatcaaagcggctctaaggagctcgtctttgctatgcaatcacacactttatcatcaccatcctcgttcatcattctaattttatgaatcttcgaagttgtgttagtctgtttttgtattgctataaagaaatacgtgaggctgggtaatttataaagtaaagaggtttgattttggctcacagttctgcaggttgcataggaggtgtgccgatggcatctgctcctggtgaggccttgggaagcttccaatcatggtggaaggagaagggagagccagcccatcacatggccagatggcaggaggaggtgccaggctcttaaacaaccaggtctcgtgtgaactcagagtgagaactcattcattaccatgaggatatcaagtcatgcataagggatccgccccaacaacacaaacacctcccaccaggtcacacctccgacactggggattacaattcaacatggggtttggaggggacacacgtccaaaccatatcagaagccttcagacaagacactactgtttccttccttcccaactgatttaacgatgacttccacattgctagttatattcctggaccccactggcatttgtgttggaggccgggacaagtcgtggctcatgctgcttttgccttttgatgccttgtccagccagagaactcctacccttcaggcctagctcaacttccaattcttctgtgtgtctgtgcctcctgacagactcagtgagcatgagcagctcccttcctgtgtccccagattgttcaaggcatatttcaacagatgaattcaattcagcaagaaccttattgagaacccactccatgccaggcataattctagatatgaggaaatataaaaattcctgccctcacggggatcccagtctcctaagggaaggcaagcagtcaacaagggaactaccgagcatgtcagcaggtgctcactactgtgaaggaaaacaagtaaccaaatgtctgtacttccacccaaaactgcagagaacatggtattagaaggtcactgccttagtcattacttatcttcaacatcaattaaacaaaactgacgcgttaggatgtcctctaccactgctgtaatggcaaaatggcagacaggagtcacttcactagaggactttgagaaggacgtgcttctcagcaatgaccctgttcactcagtaggtttatattaaatattgtgactacgcacacacagatacaattttctcagttccaaaggatgtttcctataagttattattggccattttaaactgtgagagtgttggtgctgactgtgacgacagtggtctcaacagcagcagcagctaagctgcactgggcatttaccatgtgctgggcacttcgctaagagttcttcatggcttattatttaatcctccctggatcttttattatccccatttacaaatgaagaagctggggctcagagaggttaaataacttgccccaaatcacacagtcttcaaactactcttgggctcaaatgcaggcatatgaaacgagatctcaagtgcctattcacaacactatatggccctgaaccagttgccctttagaagaaaccagagtagaacattcattagatgacctgatttcctcattctactggctcagatggttctaccaggtatatatatttgataccaggtatcaatgtctaatcacagaaccacaggaagacaaatcctaagacagccatttcatttatctacacaataaaccatcctgacactcagtggcttcaaacatatcagccatttccctgttcaccctatttctgtgggttagcaattcgaggaagggctgggctgggcagtcctggctcagggtctctcacgcggatattgtcaaaaggtggggagagctagcaaagcggggagctggccaggcacctgctccccaggcaagctcggggtgcctgcataactcactgatcatggtctctccacgggggcttgcctgggcaccgggcctcctcatagcttggggctcggggcagctggactatttacatgaaagcttcaagagcaagtgttccagccaacgaggcctcagaagtcacctggaaccctactgctagactgtcttggctacaagcaagttccaggcccacctgggtagaggggagggggccagactccacctcctggtgtggaggtggtaagggcccacttagaagagcatgtggaatgagaggtatcactgaggccatctttggaaaacagaatctgctacacaaacaagtaactcaagactcatttatagataactgagtttacagataaaattggaacaccctacccaaggtgaaggtaacttcaccttgacactcaacagttgcagttactctttaagtcttgaatctgctaagacagatgacttgctattttacctgaagtctatttgatctcttgtttggacacatcaagagcctttcacattcatctactgaataaagcgcataagtagataaagccaaaattgctcaagtatgtaagaatcaagaagaatccaagtaatgtcctctcctttgtggtcgaggaaaacgtaaaacttcaagtcaagacttaaaccttccagcaccgtttcaaatgtgatcatttcacgtgttctctttactccagaatgagagaaggtcagagctggaagggcttgaatgcatttagctgggactcttgcctggtaccagaacctgcacagggcactcccaaggagacgtgcactgtggccagcagctctgccagcccatgcaggctgcttccttttcctgagttgttacctttcgatgaatttcatcagtcagtgctagttcttcctttgtccaaactgtcaccctgataaccacacccatttcttccatctgtttctgtgcataacatgctttccagacgccactgtccctgaaggcaattccctgaacgtactccttgaaaacatgacacccatgacacccaggcccgcacagagccgttcaagcacagtcacctgtgaggaacacaagctacaagtctgttgctttcagcaagtgggcacagcctccctgacaccgcccagcctccctgacaccgcccagcctgcgctcaggacaggtgcgaccagacacaatttggcttaggttaaacttgtggtcaggatacatgtcctaccttctaactaattttcatctagctgctagcaaattagatctttctagaagtaaatgactgtacatatcttcctaagctttcaccttaaagcagtgaaaatgttttggccaactgtcccagctcacagtgatcattttgaatcaggattctgttatcaatggtcaaaatgatgacaagaattactgaagtcatcactgttgggaaaaaatgaattttggaactcaagtgtattaattggcttgtttgtgggcttatagttctccctaactacaaggttcttaattagaagattactttggtgtccagatgtggagtggggggagggtagagcgataggtgcaggaagggggatccacctcctataaacccctcttgaaaatcacctaaccataaatgttgggtatcagtgtgaaaattcagaaaaggagaaacacccttgaattaaaaggcacttgaaaaatgaaggcaataaagagactcttctcagtgatcttccccatgaggaacttaaggcattgaatccaaccagaaaaatgaatggtccaaaatacctcatgaattccaccaagcaaagcagaagcgtctgctcggaattcattttcagactggataatcagcaagcaatggggaaaaaaaggagattgacagagacgagaaaggaacacaaactgcaaagaagtcatgctttgcctcaaaaagcaaaagccagcagaagaatttcaaggaaaatgattattgatttggtatcctgggagagtgaaactctcatgagggttctaattcaatcaggttagagaggtgaagaaaaggagaattattttgccaggagcccatgccagaagcatgctagacagagaaacgaagtgagaatgctggtaacacattctccatcctcactctggtttcggagtattttctctagtgataaggctcaatccggaaacaagctggagagaggaaggaaactgggaaggtgggggagggaaaaaaatgagagaggaaaaaaaaaaagagtagcaggaagttcaaccagataggaactgatggaatttgtttttcagtgtctccaacttcaaattgcaaaccaagtgagagaagacacacgcttatgtacacaggccccggcaggcaccggtcagcacaagtacctgctgcaggtctcaaggggccctgggaatctcaattcattatcttcgatcatttctttgtctccacagaaagtgcatacatctccaatttaggtgcactccaaaccagttattatcttccaaatcaatatacaacaaagatggtgggaaaaggaagaacttggaaattagaaatgtgcaaccagccgtccccacacagaacagtttatgagaagttttctgagcaactggcagttcgtgatgatctttcaccattgaagcaagtacttctgaatagccggattcagcagggaaacagcgcctcctgacagctgctgtgtctggaggaaatacgaagcaccaatgaagtcagaggagagtccttcaagcagtaggaatgctttatcttctgagcaatgaaaaacagccacagctgtgaaaaactattctagagtgaaatgcaaggtctgaaagccagtttctggcaaattggattgatttttaaaaacataaaatggtgtgagcaaacatttattcaataatcctttctcaagaatccacaagtagattgtgcatggcgtagaatgtagattatgagtacttcctactctcagagaagaaatacttatttattagaacgtttcaaaaggaaaagacatttcaaatatcaaccatgatgctatacaaaccatgatttttatggcaacaaagtccattttttaaaaagagaagaatgatgaggcttcaactgactgaatccctaccacgtgccaagcactggagccagtcacatgctggggacccaggaatgagaacaaaaatcctctctaaggtgttcgctagccagtgtatgccacaaatgaaaaagtccacatgtaaaacacagtgaagcaatttcttctttttcttcgtttttttgagacagggtctcactctgtgacccaggctggagtgcgatggcgtgatgatagctcactgcagcctcaatcccctagactcaagcaatcctcccatctccagcctcctgagtagctgagactacaggtggatgccactgagcctggctaattttttaaatttttggtagagacgatgtctcactatgttgcccaggctggtttcaaactcctgagctcaggcaatcctcccgcctcggcctcccaaaatgttgggattataggcacgagccactgtgcccagctagcaatttctttattagacgcaaaaaggtcagagagaggacagaaagcatgatttaagtttcataaacatgtcctagaaatcttgcatttagcttggattgttgtttcgctttgatataattttcttttaatttctatacattatattcaaaataattaagagagcacattctttacttggcatagtttgttccactacacaacacaaagttcattcctactatgcgcacaaagaaaatttacattttaagtaatttttttttgaatgaagacttttaaatgcatagtcttagattttaaagcttctttttggaccaaggacaccttcgaaaatccaatgaaagctctgcacatgggcccacacatgttttgcatgcaatttaaaggaggtcacaaactcactatagtgagtgtaccctgagatactgccaacaccatgagctctccaacaccagcaggctacagatgacaaaactggtcacgataccactttgtacttacatatcacttcacagtttaacatacccctgaagttattaagtaaatgatttaaccaattggagtgaactttaaagacatcaaatgatttgatctctacaaggagttctctaaagactcataaaatagaaaataacactgagcatggctaagtgcaggaagtagatcatggaaacgacaatcggcctttagcactgggtagtgacccctgcagatctgagcagcctcagcatcaaacggagagaccatgtggtctgtacacacgatattccactcctaatcagacgattctgtcggcagctgtgattgtcagggtcacgggcggtgttggaggggtatgcaactatgattggggttagcacaagggaggccttggtggtaatgaaatagttcaggatcttcactgagataataatggttacacaatccacaaatgtgataaaggggcacagagctgtatgagcagatggtaccaatgccaatttcctggtttcatcatgctgtactgtagttacgtaagatgtaaccactggggaaaaccagatgaagggtacacagaacccctttactatctttgcaacatcctgttcatctataaaaagttaaagaaaaaaccctcatgactattaatcaagggctgcagatgtttcttagatataaatacattcagatcatccagttcaatagagagacgaaaaaatacacaagcaacacaacatctatgctccagatgctcaagctctttcttaattcagcctccagccaataaggaagtcaagtcgttcttcaggctggcctggacacctggtcacatgcttgtcaacccctaacagctcacctctgactacaggtaaggtaaagaagttttgaaatttaaaccattattttccacaaaatagcaacagccaatcattttcccacaaagttacgatacagcatcaaccactggtgtctctggtgaagctcaacagaagctgctaaggcctaactaacccccttcaatgtagattttttgttaaatgagaaagagttcattaacttcggcaggactgctgtattatcggagaaaggctgattttggaattggacggacacagatttaaaagcccacgtgtgccattttggagcattctaacaattctctctgtgcctcagtttcctcactgctacagaggagatactgatatttacatgacgggattgctgtgaggatgaaatgagaaaaatccagcacagggtttggcacacaggtgcttaataaaattggaattctacgatggcagtcaggagctgtagaaattaaaatcagtaggcttcccttattgcaagggtgatgctgttacccaagccaagaacatggttaacgccaacgttctggaactctggatgctgaagacagatcagcatcggcacctaactagagcacccacagagctactgctaccttagtggcccgcactaccacggtttccaggactctggagggaggtgacctccagcaacaccttggcctctgcaatgccaaatataaatccagaccgacggagctatgagagtcaagcgaagcaacaacatacaacattcccgccaactgaggatgggagccgaaagaggttgtattttcaaacaaatctgatcaaagtcctcctgcctttgactataagggctgttgtaactaacaaggttaaggtttcttagcaatagtctactcaaggaaggtaccggtatacctcaataaaagcaaacttaacatatgaacatccacaaggatgtcaaagataaatgtagaggtcattttgctttatagaaagatactctgtttgtcttaaatgtgattacatttaaatagattctgttttctgcacacatgcaggcatgtcaaaaggaaaatactgcctagacgcgacctcctcagtgtggcacacaggtcagcagcagtatcacctgggggctcctcggatggggatgtacaggctctcagcccccgcccaggcttcctgagttggaatctgcagtttgacagggaagacctgtacacacggcaggacttgaggagctctgtcctcagggttactcacgacccggaagccagaagctctcagtacagctgcatggcaggctatccccgtgttctcaaccctcgctccttactgaacgtcagaataactgctgcaacaattggggaggaattaaaaaaaaattttttttaaatttttctccttttgtaatatagatacctggaccctgaccgaagatttaatttaatcggtcttgggcagaaccctggcattagcatttgtttaaagctcattaggcaatgccaggacgaccttgttgagaactatggctacagacggagagcagggcctggtagaagaccacctcaccaacaggtaggacctaaatttatcactggaagaaaacactgaactggaagagagagagagatgtgactaatggaaatctcacacaaaacacgatgttgcatcaaggttgatcatctctacacacactggaccaaaagagattttcctggggctagcattagggaactgcttttgaagctcctcaaacacaggtggatgtctcactttaacatgacttagctaccaaagagtcaagtaacaccacacagtgttgaaaacctcaaggcacccaacacccaataaattctcaaacagaaatctgccagaggatcagaaacctctgatctcttacaactaagagctttctgcaccaaacacataaattctcttaaagttctacaaaagcccacaagtaacatttccctccctgatctgttcaactgtacattttcatagagggtgtccgggagggcaaaggctgggggtggtgggtgagcagcaggcagaagagaggatcaacgtgcagggatgtggaaacgccagtacagaaggcacgtgagccccacggggctggggagatgggggttatctcaaggtatgggagggacgtggagttgatacaaaggctcagggtgtgatcgtggggtgggggcagctgttgggcagagcaaaggagatggagttcaagaggcgcgggactggaattctagttcttcctgaggacacggagacgactgagagagtcaaggaagaggggttggagaggaggctgggataagccagaggccatgtccttggtgaacaaggaagagtggcgtagtccaggtctcacggtgagcactgagggcagaggtacaaccagaagccagcctgtctgaccatggctctttccagcagccccttgtgaaggagcagccggcacggccggatgtcagagcggctcctccctagtgaccactgcctatcccgtgactcagcatagtccgcgcaggcaccaaagccaggtatcctttcccagcctgctgcttccatctgctgagggtgcaggggcagacaggggctaaaagacccaggaattcagtcccaatctgcacagggaatcatctaatgagacttctaaccactggtaattctggactccctaaaaattattactattaagaaacaaaccaccaccctagaaataaagatttctgtcagtctggaaaaatgccaggaatcaataaaccaagtcttcttttttgttctatggtcaccaagggccctggctacaaaccaataaaagatcatcagtacaacataccagattagctgagtaacagtggtcacaaccatatattccagattttctcagacaatgccagttctaaatacttttagcctgttatctttagaaatccataatcctaatatatctcaaactatatccagggctgtctcttacacttcaaaacagcacaaaaaattctttgcaatattatacagcccaatttaataattagaataaattatggagttcattccattgagggtgtagtttagtcaccccattcttttcttctagttgtaaggcaaataatattgtataatagaggaaatacccatcaaacccccttatagatggtgctgatctagcgctgtctcaaatgctgttagaatgggacaggctggttctagagaatgaaggtgacatgcttcctcccacctccattccaagtggagtaatgcagtttgagcagaacagacaaaatccctccccttctcggccatggaagagatattttcccctctgattgtatcggcaatgggtgttcttccccaagtttaatctagtcctcacaccaaaacaaaaagaacaaaagccaaacaccagaaaacacttattcttttttttaaagattccttataaaacattatctacccactaatattatgaaaaggatcatatctaggctgtgcatgaagcctccaaagtgttttggaaagtttgtcagaaaagtactagtcatagatagaaacagtcctatacacaggtgaaaatcagacagtattaaagcggaacacggaaactgtacgtggctttatacctcgggagtcttcttactctgtcttttcccaaaaatgcagtcaagatctgttttgctccgagatgacagatccttccctagaaaaacaatgtgatgcttttcagtaagactgttcttcctaaaagaaagagcgcagacatgaactatgcagcacctcaaaggaaaatggcttttgggaaagaaagaaacaattttgaaactactgactttctacccactttttcattacaactctttcattagtaaacaaaattaattaaattttaaaaccaagtaaatgttttagaaccagaactcttgacattctcttaattgtagaaacaacctagagcatactgactgcaaggaaagctaaattctacagctcaccctactcccgctatgccctcaagatgcaattcctgggtctctgggttcttcatttaaaaatagatctcatttgcttcagagacatgagctacttacttagaagattacgaaatacacatgaaaaaatatcactagatacacagctccagaccccacatatgcacatgaatgagaacgtatcatatttgacacacaggatcttaataattaactcaacaaataaaaattttaaaagaatatatgtaaatcaaaaatactgtaaaagggtgacagggtttcagatttttcttcttaaaatgttctttactgctctagctatattgtctctaaataaaaagctacatagggagagtaggaaattaaatggctctatggttcttatttaaaacactaaactctttaatttcaaacccccaaaccaactaatttaaaattcacttctttggaatttccacttctacccaataatcctctgtgagcagtaggccaaatctagtcccatttgtcaacggcatggtaaatgcattttaaaatgtaactactccatgtaaaggcttgaggctctgggcgagggaggttctgggtcagacacaggaatgtgagtctcacgctggaagccgagttccaccgtcacagactcacttgtcttcttggtttcctgtagcacactgccttggcaaagtaatgtcatgacccagaaggttctagttcactatcactggggcacttaaatatgatattgctcagtgactccgtgaaattaaaaaaacaaaacactcttcaatttaatgcaaaaccaggtgccaaaaccagtttcctaggcagcagtaccagatgaagtggcccaggcggtatgacctgttcctgccaggagggcaggctcctctgggctctggctgctgctctccttcctacctgagcttgacactaagccctcctgcttttcatttatgattaaataggacctacacaaaaagacccaaaagaaaacctacttaagaatagacgatgcacaccacagatacggcagaaaatgaaccgggaaagtggggaagaaaactggttgtagcgggaagaggtggacaaactcatcggaggtgtagagatgtcctcacagctttgctgccagcacaacccattttccaatgcaaagcacagtttgtacttcagaaaaggcagctgtacttaattcaaaatgtgtactggccatctatccctaacctatcctctggaatagagacactctagaaaatgcaaattaaggtctcttctatagcaatttgactaaaaggaatgctggagggattaaggaagagagggtacatgcgagatcacagttctaaaacatgatgtcaaaatgtgaacacacagattcaaaacagatctgaaagtcaaagggaaaactgtcaagctggtagagacagtaagctatatcaatgaaggtgcaaatgtgtctaaagttttgatgatggattcttgtatcagaaatttttagcctttagcaaagttcacttaagtaaatgtagaaaccaggattgttacaggccttgctctggatttgatctggaaaacaagaacacagagaagaaagaagagtcagagaccagtggaaaggaacataaaaggtggacaaaaaggtgaagatggaagtgaccttgagatagttactaattaatggtcctgatggaaagcttataaacaccaggaaattatggccgcttttgaataaatacgacaaatttaaaaagcatttaaaaagcttatttgtttgagttctgaattatggtcaaatcatacaaaatactgttgataaacttagagaaaacgacaatgaagaaaactgaataggaaacatctatctggatttggttcatctattagtcttcaatgcgtaacatttccagaaccagtaagaaaggcctccaagagtcaaactgaaagttcctgcaaggatgagcaggtactttcaaggaagaacactctatttaggtttgctttagctgtttgtctaataatcatgattatcagtttcccagtctatcagagtagctactgggaagggaggaacattactgctatagtcagacacatttacaataccaagaaatacacatgggaggcaactaaaactttcattgacacgagaacttaggaatcaagatgatttggaaacagtttagcaataacccaacaagctgtattagaactgaggctcaaaaaaccaactctatggaaaagcagagttgagctgccgagagtaaagaagtgaagggcaaggaatatgtttgctaaaataaaaaaacacttaaggtttatgtaggtagcttcaatagtttagaaaattcatttgcattattcaatcaagaaggacaaataaaatgacatacttttatttttatctttttaaatggcaaacacacagaactggcagtcaaccgagggcagaagataagggtaactccactaaaagacaccataaaccaggaaagtggaaagagtcagtgtgagtgacacaggtcagacctaccaggtgctacctgatatttatttaaatgtcaaaagaatcagaagaggagattgaatgctcctcactaccagtgtgcaactgaggggcggggctgactgcgctgtgaataccaattctgtatttcccgaccaggaagccgagcacctgcacatgcgttaggcatgtagtttccttgtttcagtagcatataaaatagcccaaactctcaaaaggattaagaagtctgcaagattcccaggataaagctgcacaattacagtttatgcaactttcatccaacaactgcataactgaggggaggaagcactgctctcctgctctcctgccaacgtctcaccatccagtcagaaaacctcagaaatggctttgtatcgattgacattttcccctctgcagatatagcctctatctgcagagaccttttgcattaaaaaaaaatacaaaaaactacaaaccaagctggagttgagcctttaaataagtatgataaaactgacatttaaaattatacaataaattagctcaagttagaattataaactcaggaccagggaaaggaataattatatatcagaactaaaacgatataaccaaccaggtgcagtggctcacacctgtagtcccagcacgctgggaggctaaggcaggacgatcacttgagcccagaaggtcaagtctgcagtgagctgagactgttcctctgtgctccagcctgggcaacagagtgagatcctgtctcaaaataaaaataaaaataatgatacagctgatatttaggcagtagcaaattttacaacactatttgctactgtaatcttagtagagtaaaattttaatcttcactcttcccaagctatgtacaattgcatcttcctgtttgatttcctggacgatacatgagttgcaatatgaatcatcctcatcaactaagtgaatgagttacagtcgttatcagcatacccactggcgaaaatctttattatctacaatgctgaaaaagcaaaagttccatgaaatgggtcatttctaataaatcataaaacagaacctaccttagaacttaatagtcacttacaaatgtatccacattttacaaaagaggaaactgagtctgaagggaaatgggtaggtgacttgtctgagcgagtaatggccagagtgagattttctgtgatctaagatagtccaccctagaggaaactttaaaataagtgtgcaccgtgattggaaagctagctgataaaccattcttttcctcactccctggacttttgcttccttctccctttcctacgtaggcccagtctgcatgtccttcccgtctccactccagctcttctctgcaatctgacaatagatccgagaatccttctgttctgcatactgactccctcttctccccaggcaaggctaatagatacagaaccctcgctggaagacagaaaacgaaggcacgaggcactcagcggtctcacagggtcacccagcaaaggagtggcttaactagaaatagaaagcagatgctcccggcatccattagattaaagcagattacagaggcttatcccagcctcagcaaatgcttcagatgaaatcatgcatgcagtctggcatcaaaggaaaattagaagattctacctgtaaaagtgaaagcgtaaaaggctgccacatcatccgaaagttacaggtcactgagttttattaatttgctctgcaacagcaccttctgtgatctctagtttttctctacagtctaatgaaagaagaaatgctatttcagggactgggtatgaagtgagcatgtaccctctcttcaaaaggactgagggccaaggaagcctgtattctgttccatagcacgctggggtggagaagaaccccagtcagaagggatacgggcgacagccaagaaagttccatgtgagagaaagaacggaggaagcggaagagccacggctgctggagagggaagggaggcccagcctctccctgcacacaatccccaatccactcagctctgccacggcctctcacctcaaccaaacccagccctcacttttgggctcctggccctaaatgaaaagcatcatcaatacttcagagtagtggggattccagctcccactgctatccaggctggctgtacaagttaagagcttcccagcaatgccctgatacgcatgacattcctagaagaccaaagcagagatgtgctgttcctggcatatcaaggtagaaacacatccaacctcccaggaaagaaccatcaacagagactagatattacagcatcagcagcatcatcacgcttcttatgtaaactatgtaataagtaggtttctaattcatgatactgttctacagacaaactggggagttggttctattaggttaaattgcttctttccaatgcaagatcgccacctagtggctgaagacaacaaccgcatgcacaaatgatttcacatactgggaaggggctagggaggtggtgatgaaggaataggaattctcacccaggtctcaaacggctttttacccgacttggcaatgactatggaatgcctacgctgtgaaatggagaaattacgtggaataaagggtcaaccagggagtgtgctttatcacactggaggtatcaatatagagcataattctctaacctggcgtattaaaagctatttaacaccaactttcagctgtgaaaaaacaccatgcagctaaaaatgttgggcaagaaattaaaattattttctgacctagctacataaagtcccgttttcctctaaatataagctgattccattttttagctcagccacaggacttgtttacagtctaaaacctaatctgggtcccatctcagatctcctagatctgaattctaacaagatcctcaggcacaccacagtcaatgcgaagactccagcgctgtttcacagcaatgcagtcggagctgtccataaagcatgaagtcgctattggcccagagctaaaatgcttcaagcaactcaggacaaacacgtagatttcaataacaagtaaagaaatgcttaatcttaccttttgtgaatttcatatagtgaacacggtttttggagattttggacttttcctcaaggctaaaagatttcttttccttcttgtccgaggaatctttaaaaaagatgaaaaaaatacattaaagtctttctaatccaatctcatttattctcctaacagtggatagtcttgaaagaaaattttaggagccctatcattaatgattgaactctttcattcatttgctctgcaacagcacccttctgctggatctctgttttctttctaggagtcaaatgattagaaatatttccttaatttgcatactatggatcaggccaggctgccctccagaaatttagaaaatccttgaggaagaaatggaaacttgtgttcacacaaaacctagacacaaatgttcacattagccttattcatcatagcaaaataccaaaaatcacccccaagtccttcaacgtgtgaatgcatgaacagctgagcaacccctgggccatccttacagtggaataccactccacagtaaagagcggcggccgctgccaccgcaatggccaaaacaaactccagggcattgtgcttagtcagaggtccatctacaaacataacatatgactccatctacagaacattctcgacatgacaaaactacagagagagaggacagatgaatggtttcgaggggacaaggatgaaggtacagtgggtacaaatacaaagatgaggcatgaggttgctgtgccgtggtggccaatcctgtatcttcaccattgtggttgctgcatgaatctgcacttgtgataaaattgcacagaaccatccgcccatgtacaaatgaatggagaccaaaaaaagatgatgaaaactggctaaggtttgtggtgcagttgacagtaacaccaaatgtcaacttcccggttgcgaaaagccacagcaatgtaatgtctctccaccctgggagaacagggggaaagacgttcaggactctctgaattattttgcgaattcctacaagcctgtaattatttcaaaataaaaagttcctttaaaaagtaaataaaggtaagacaggttaaatgatcacctaaatacagatcagagatgacgattaggtgacgcatggaggagcagcaatagctccaagccaccttttcagggtttcgggaaggacaactggaagggcaaaaggagcaggaacacaccattgaggaagacatccgagtggtaacgcctttgacggaagggaaaatgtgagccagaaagtaggtccttgcctgaaaggttgatcagagcaggttgatctggggttagagtcaattataaattagctagccacctgcattctctcacctgtatctgcttgtcaagttcagacagaagagtgccacagaaacgatcataggcagaagagagactaaattttcctacagttttaagaacattcagatatgaggttagagaaactggaaaaaaagcagccgggcgcggtggctcatgcctgtaatcccagcactttggtaggccgcagcaggcagatcatgaggtcaggagatcgacaccatcctggctaacatggtgaaaccccgtctctactaaaaatacaaaaaaaaaaattagccgggcgtggtggcgggcacctgtagtcccagctactcaggaggctgaggcaggagaatggcgtgaacctgggaggcagagcttgcagcgagccgaaatcacgccactgcactccagcctgggtgacagagcgagactccatctcaaaaaaaaaaaaaaaaaaaatccaacaaaccaaccttcttcagaggatataagagaaattggaaaaaaagaaactctcaccctgacagtggagcgaaacaagcacgtgtccattcaacaacatgtgactgcactgcaacccctcccaggagtcacttatttcaaaggtatagttccctatgggaactatacagcaggctcgaaagaacgtgaaggcagatgttccgcacttgaggcaaagcccagcacgggctcattatttccacaagctgaaacattctcttctgcagccacttcccagggacaccttggattttttgcaaagacatcctaccagtaaattcttctcttttgcacttcatatggcacataacattttcaatgctgatgttccaatcacaaatcacagaggaagttatcagcttaaagcggctcctaccgactgcaagtgtatgagggacgaggcgctggactggaggctttccatgaattcttggatttccttcccacagccactccataagagagctgctgtgatgcctgaactcactacagaggacgacactgataaggcacacccaggaagcccccgcgatgggaccgaagcccaggcagacatgacgcagaggccacatcctgaagcaccacgccgtgccctcacagagcagctctctcagccttgagagggcagaagaatcacctggtgagcgtctctaccttctcagcatgcaggtatcaagaaggatgcgtgagcaccgccaggccttgaggaatcactttctatctatttgttcacgtgcactcatgcctgaaactgctcggagtctgacttatgcaccaatctggccgtcctttcccgggtatcccctcccactttacaaaggaaaggcacaactttcctcttaccgggatcaatgagggacaagggaaaatactgttgtcaaagcagcaatcaaagcagctggcccggccctcacacccctacgctaacccagctcatcaggaggtgcactgccaaagagatgtgtttaataagcattcattaaaatgtataacagatctgctaattttattcactgtgatctactaatcatgagggtaggtgcagtggctaaagcctgtaaccccagcaccttgagaggctgaggtgggtggatcacaaggtcaggagttggagaccagcctgaccaacatggtgaaaccccgtctctattaaaaatacaaaaattagccaggcgtggtggtgtgcacctgtaatcccagctactcaggaggctgaggcaggagaatcgcttgaacccgggaggcggaggttgcggtaagccaagattgtgccactgcactccagcctgggccacagagcaagactccatctcaaaaaaaaaaaaaaaaaaaagagagagagaaaataaaaccctagattctttatgaaatccttcagagtaaagtaaattttctggccttaatcgtggtttatggctctagatttgccagccacactatcaggaggcttacagtgctgagtatctctgcttgcttttcttagatgttataatgcatttagtcctcacaacaaccttccaaagatgatactactgcttccatttaaccaaagaggaaatcgaggtacagccatgttcagcaatttaccgaatgtcatacaaatgaaaagtcagaccaggattaaaatccaggcagtctaactctggtgtttgtctctaaaccactgcattctatttaatctccaagtcttatatgttcatgcttacattcttacattctttttttttttggagatggagtttcactcttgttgcccaggctggagtgcaatggcgtgatctcgcctcaccacaaactccgcctcccaggttcaagcgattctcctgcctcagcctccaagtagctgggattacaggcatacgccaccacgcccagctaattttgtatttttaggagagacagggtttctccatgttggtcaggctggtctcaaactcccgacctcaggtgatccgcccgcctcagcctcccaaagtgctggtattacaccgtgcccagccaagcttacattcttatctgtgtttctactgagttcaactgtgatcgtaaatatcaagatgttttctgtgtataattagtaaggaatagtgtccttgaactttactacttcatagatcctgcatttcctaatatgagtcattcagtattttcagaaaacattttccttatctttttcttctgctaataaattattgcccttcatattaggaccacacacagaactgttaggttatttcaaaatcatgatcctatggataaggaaaactgtccaagttatacattccaacaaaaagtccaatctggttagaaaaaataccaacaaagcacctttcccttcacactgttgggctcacttccacacacgtcactgcaataaaccttcctatggttagatgtgtgctgtgattttaccaggtaattaccagcatattctgctagctacctccaagcaggactgtgtcttatacctctgcagatcctcacacctaaactagtacccagcacacagctcaataaatgtttgctgaactcaagtctaattcattatttcactccacaaaattctttcaatctaccaaatatcttttgattattcacacatgacacacaaggaatagactgttcataaacaagaatgtttataaaaatgcttgcagattacaacaaaatccaattaaaaaatgggcaaagtacttagacacttcttcaaagaagatataaaaatggccaataagcgatgaaaagatgcttaacatcagtcattagggaaatggaaatccaaatcacaatgagacatcatctcacacccattaggatggctattatcaaaattataaaagataattactggttaggatatggagaaattggaactcttatgcactgttgatgtagccactacagaaaacagtacggcagctcctcaaaaagttaaaaatagaactactatatgatccagcaatccactcccaggcattacccaaaggaaaggaaatcagcatgttgcagaggtacctgcaaacccacgttcactgcagcactattcacaacagccaagatatggaatcaacctaagtgtccaccaacacatgaactgggaaacatgtggtgcatacacaccacggaatactatttacccttacgaaagaatgagagtttttcatttgaggcaacatggttgagtttggaggacattaagtgaaataagccaggcacagataaatatcacatattctcgttcatatggaaaagctaaaagagttgagctcataaaagtagacagcagaatagtggttattagagctgcgtaaggaaaacagctatgtaggaacagctaaagattggctaatggatataaaagtcccactacataagaggaaaaagctctagtgttctatagcactgtagggtgactataataaataatattttattttatattttcaaatagctagaagaacagattttaaatgctcccaacacaaataataaatgtctgaagtgatatatatgctaattacgttgatgaacataacacatgtgtacattacaaattgtgcacaggtattgacatatcacactatactcaataaatatgtataattatgtgtcaactaaaaataataaaagcaaaaaacaaaaagtagataaacatatttgcattgagaacttatgtcatctgatttccctacctgtggtttcctgcccatggcaagtgttcagttcggccagaagctggttaaaatcatcctgatgggcaatccagttgtcctgaaaatatcaaagaaatgaacgagaggtaagcctgtagtttacttacactgactgagatgatacattttggaatcaaggaaatccagtggttaattaagaaattttaaatgttccatcaaaatactatttgataaatttaagtggattcaagaaataatataaagttaaaatgctctttatccaggtcaatattaaaaaggggcttcctggaagcttaaggcctgatttcaaatgtgaatgacttatcgatcaagtcaatatatagtaaataatcaacaggcaacctgtgtgctaaatgttaaagtaaaacataatgaaatgactatttttttctcactaggggaaattccatagttgaaaggacaagaaccatgcgggacaaaaaaatgctcttctttgcttggtagaattaaaatcttctaatgacttgcatcaactccaattttacaaaactctgaggaaggggaggaggaagaaccttaagtcccctgaatcgatgagttcccatttgtaaggtggttacctaataagtttattataaaaaaatgaacctggcttttataagagaatgaagatctcccaaaccagtgggaagcagggtttcagtgtacgaatctgccttactcacattcttagcaatttttaagaatgcttaaggtaaaggaatatgaaataggtttactgggcaatgcttcttctaagaaaataagtatatctgtgttatctatccctcaacaactacatttgaaatcaactttatataaactctttctttagtggctaaaaattttagctccgccaatccactactcagagatacggaactaaccaaagtaattcaatttacctaaagtaatttcccagattccctaccagattatgttggctgcaaaaacttagaaacaaaacttttcagtttagatcctttccaaaagggaacaatgatactaaaaataaaaagcgcggtaggccactgactctgagttatagtgccatgcattcaaagcgtcagtgttcaagaggaaacgtgaataaaaagaagtgctgcaccaatggtcagaagcagatgaaccaatcaactttcagatttacaagactgaagccaattatgcaaagacacccaggaggcacacactgctgctcacttcattattgatggtagctccgagtcccaggtggttatttttcacttgaactttaatatgatctgtggctccttgctcctgagcccctaaaccctgtggagattaaacacagagagttagaacattcctctcactgatactcagaagcagagcactgctacaaaactcacagatgcctacggcaggtgttctgagttgatgattctctccattaaatactttcacaaagcaacatgggggaggactctaagtcctctgcatcaattagcactcatctgtaagattttccaggtaaggaaagatcaagtgcaaagacccgaaggtgggaaaaaactcagtgtactgggaaacctcagaggcacccagggtggcttctgcaaattaaggaatgaaggaagtaggatgacggaggggctagatctcacataacctacgggaggaatttggattttattttaaagacaatggaaaaccactggtcttttaaggatgacatgatctaatttccatattttaaaagatcattctggctgctgtacagcaaatgggccagaggagaaaaaggagggaggaagggaggcagctgagagtctgaccagtcagtgagctcaagtgatgacagtggctgaagcagggctctgccctgcatggagaagagacgactggggtgcgggaggctggagaagagacgactggggtgcgggaggctggagaagaatgacaactggggtgcgggaggctggagaagaatgacgactggggtgcgggaggctggagaagaatgacgactggggtgcgggaggctggagaagaatgacgactggggtgcgggaggctggagaagaatgacgactggggctgcgggaggctggagaaaaacgacgactgggctgcgggaggcaagagggcggaggaatcaagcatgactgtcaggtttctggcttgtgtaagtggcagacggtgccatgtatgaaaaatggggaaaacctgggaaaaatatatttgggggaatcaagagttttataatagaaatgatacccttgaaatgcttactcaagtggaaatatcaagtaggctattgaatttacaaatctagagctcagaggacagaactggactcaatatagaaaaatgacagttcccagactttagctaattcaaagtgtggcaagggaatgaatgagatcactgcagcaaagtgcaaaaaaggggcctgaggttgagcctcaaggagccctaataatcaaaagtctatagaaagaagagacagcaacaaatttaggagtggcaagtgaggtgaaaagaagagcagaagagacaatagcactgtggaggccaagacagaagtatttcaaggagagagtagtcaattacatccagcactgctgaggagttaagtaatgtgagaacaaaacaagcggcccactgatttggcacttagagatcgctaaagacctcaacaagaaccatttaagtgtagaggtatcagcagaggctctactggagtcaagaataaatggaaagggaaaaagcgtgtagcctagttgcaatgtctatgaaagatgctaagcatggcagcttaaatgatagaaagttgacacttatgtccaatcctaatttatcatcataaggtcacaacaatttttgatttgggatcaaaatcacttactgatccaaagcataagtttcttccagtctcctaagaaggaagttttcccctaatttctaatctcttttcatagctcagatttttttccgcttttctccaaaatacctttcctttagaccaccccatcttctctagcatccgctggccaaacttggaatcgtcattactccaggcagtgttctgaggatccacagcccacttctgcttccgccgacctgtaaatgaaaaagcattatcatcagcaatggagatgatacccggaaaataccacacaaacatacacatgcacaactttgtgtattttatgtatgtatgtaaaatatgacatacattacaatacagaaattaattcaacactcaacagaatgttagactggatcatttatcctgatttccctaataaatgtatattctagacatataagttgacctcttaagattaaaactgaaatgttccctcataatgtggcaaagcaaatgctcaatatactagagctgggccttccatactccgccatcagcacaactgaaagcacctgtggacaccagcatcctcatcaccatcagcagtagtagcagcagcattacagcttccattgccatgcgttactacatacaaaagaacatgcaataccaaggatgcgcttaaaatagtaaatgccaattattcaacctgagacctgctccaaacgctgtacataatattcagttttcacagtaccccaacgagtgtggatagtaccattgtcactggcagatatgaaaatctgaggcttagagaaagaaatttgccgaacatccccaagcaaaaaccagatcctttaaaccaaccttggtcctactaacttcaaagcttatattcttaattcacaacatacaatagtcattatgctcttggggagagtcaactgtaccctccacacatgtgacctacagataataacaatcccatccctctcattgagatgccctgaagccctctgacccctctttgaacttctagaataacttatctgtttcttaacatccactgtattagggctatttatatccgcctttccggtttcccattagaccatcatctccttagggctcatattcatgtcttttttctgaggcttcattgcaagaagtaaaaaaatcactgtgcccacagcaggcactcaataaatatgtgaatggaataaacgataaaaatgaagaatggaaagaggaagaaaggaggaaagaagagggagaggaaaaaaggaaggaaggagtataactgaattaagggaactgctttgaatctcatcaaagcaactttttttaatgcatataaattactgatcattatgaactccagtttatcactgtcgttttaaggaaaattatggcaaaaataaagaactccaaaggttcaaagcacaagaatgtcaaactgaaaagtagactgtggcgaaatgagaaatttggaggtgtcattatcatttatctgccacatcaatataagcacattgtctcaccatcaacacaacccctcctaccttgcccatctcatcacataattaaaaaataacatgaccccctgtcaaaggggctcactgtggcacacataaaatcaatagaggcccataactatgcacactccagcaaaaataggaaatcctttacaaatacacaggcagaaaaaaaggcccttaacaaagcaaaacaagttgggctcgaatttgtagtgttttgcagaaaaaaaaaggtgacccaaaaatgttccatctaaattaccactttacttatcttggcaaatactcagcataacactgcgtctgctaatgaacaacacaccagagagaagcctgttagccagtattctatatgcaagctggcatcagtgtgtcagagttcatgtgtctatgcagtgcttgccaggggtctttgactagggcttgtacgaaggagacagttttgagaataagctcacgctctgcagttaagaactgcacacgcttcacattacctacttatataaaacaaactataatgcctacacaagagattagctattcaaggtcaattcctctcccctgggaaaatggcagttagcttcaatcaatgggatcacaccagtgtttccaaacaaggatgttgggggggcggggggtggcagtttcccattgaaaatgagtaacactgggttaaactaaatttcatatggaagaatctcccggaaactttactatgcaaatgtgcagatcctcttagaggaggccagagcaggcctgccatgcttcccagacttcacttgaccagaaccctgcttccctggaacatttcccagctctaatggcacccaagtttccaggtgtggaaaatcatggtaaggaaaagactgcctctgagctgttccaattggatcaccttttacatgtcctttgtaattctcatgccacagtctgttctgtgctcagatctcagctttgttcactaacacagaaggcctgactgctatcctttgaaaggcctgttcataacagggaactcaagggttcccaccattcgcagaactggtaagagtggctcattgtgcctgtttatgcaaatgatacagtttatgctgagcacctgctttccttctgcgagccaggaattttggtgcctcccaggtagagggtgtctatgtgaccaggccccaggaaatccctagcaccgagtctctcactagcttccctggtgggcaacattccatatttgctctcagaactcactactggaggaattaagcgtgttatgtgtgactccctgggggagggctctggaagcttgacgcctggcttagcctggactttgccccgtgcatcttttccttttgccggctttgctctacatccttttgctgtaataaatcttagcagtgagtgcgactatatgctgagtcctgtgcctgaatcccccagcacatcattgaatctggggatgatcttggggacccttgacacgatctggaacagcagtgtttacagcatggcgctgggcctcaggtagaatgccctgaatctgcagaatcactatttgggaagtatttaaccatcctctagcaggtactcctatgtggagatctaactgtaaatgggtctgtcgggatacttttggggcaaatccaataaaaaccatccacacaacagctcaataccacatgacttatgctaggatcccatttactctaaagggcgtgttgagtcccaagagccagaggcagaagttttaaacaatctctcaaaattcagaggttgatcagaaggagagtattgttacactaaattaaatttggcctgaggaggcctccgtacttgagtccttacataaggaactgcaacctacgttagaacttaaaggaagcgaaagcctaccgtaggagtatactcttataacatataagtgagcctcaatccattacagcagctaggcttcaatcacaggcagccatctgattcaaataaggcaaatcagagcggtaaccctaaccaagttgtcgctgtacctcacttccgtttactgtccataaatactgcctgaccacatagcaggttggagttcttagaaccggttctagttctgaaggctgcccaattcttgaatcattctttgctcaatcaaactctgtataatttgtctaaggtttttcttcttaacaacaccaatcctaagtatctaattacagaagatgctatacccatttagcaaattacgaaaaagaaaacacaaaaatattacatattataatgacaaggatttgacaatttggaataacgttgggaagaggagaactgaaaacactctcttgaaatcatgtaatctgaattactgatgcctacaaatagcattttacacctctatacttcagacttttcaaactatgttcatgttcaccatctcactgatttaaggccacctagggataaaaatattaagagaagattttgtggcctcacaaacactgatcaaaggaacagacataaatgaatagcagaactagggccaaagtcgccaagtgcatgctgaattaagcaaacatcaaagaatacgaaaaccagaagagatcttagctatctaggctctaaccctgactcctcattttttactggtgaaaaaatagaaccgacgggttcagtctaaaacatactcatttctatgggtctccgctggtcttactggcaagaacataaagatacagagataactggatcaattttgccattttctacctcaatgactaggggcaaattattttcctttgaacgtcaatttctgcccctgtaaaatcgggatggtgcctgacccatttcgttttgtgctcctaagtcctccaccctcttagaaaagagagtgctaacagcacttatttcacaaaatccctgtgctggtctgcttgatctgttaaataagctgtttctgttctttgctcactgtacaactcgccaagcaggacccgcttttcaggatcaaagcatgactgccatctggcggcaagcgaccttcgctacaggtacaattcagaagttcagcagcctctacagagacaggggtttcaccgactccaccaagtgaagataaatgtcaaaggtaaacaggcaggacggggcgctgtggccaactaacaaggtcaaaaacgccagtctcacttagaattacacattagccctgcactccctcgctaagtggctgacgtcccatatttgagacttctaactcctttgctttttctttttctgggtccaagacatcttggacaatgtgattacagtttcaagtgatccttctgctcaaccttctctttttaacctcaggaagctgaggtccggggtgggtgaagcaaccagtccgggaccccacaaagggcggcggcggggccagtcccgggacccggtgttctgacccacttcgcacgcgacccagggtgattctgagaacggcgtctccgggagacacttgcggtctctctcactagcagacctgcggccaactttcggggagctctgcggcgagcaggacaatcagagccgggctcggctccccggtcccccgatcccatgcgccaggcgcgccggcaacccgagctcccagccactccgggctgccgtgcgcgtcacccggcatcttcaccaacgcgcctgggtcgggcctccgcttccgacactcacgttcagccagcatagacatgtcggagagcctgtgataccgccgcctctggac

SEQ ID NO: 1935 - DNA, 1117 bp, Homo sapiens
atcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccat

SEQ ID NO: 1936 - DNA, 1703 bp, Homo sapiens
atgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttgggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtcccggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaag

SEQ ID NO: 1937 - DNA, 100 bp, Homo sapiens
tcttgcagaacgaggtgaaggaggtggttctgctcagcagtcaacagtggccacatctccacctgcagcgacttgatggcttccgtgtccttttcgtggg

SEQ ID NO: 1938 - DNA, 1117 bp, Homo sapiens; identical to SEQ ID NO: 1935

SEQ ID NO: 1939 - DNA, 518 bp, Homo sapiens
cttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccaggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcg

SEQ ID NO: 1940 - DNA, 518 bp, Homo sapiens; identical to SEQ ID NO: 1939

SEQ ID NO: 1941 - DNA, 100 bp, Homo sapiens; identical to SEQ ID NO: 1937

SEQ ID NO: 1942 - DNA, 349 bp, Homo sapiens
gctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccaggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcat

SEQ ID NO: 1943 - DNA, 27572 bp, Homo sapiens
ctgttgctgtcgctttagtgactcttctctgccacacgcttcctgtgcctttgccttcctctggtgtgattcggcaggaagaccaaagaggggaaaaagaagtcacgggcacccctttgggacctacaatcagagaggaaggttactttccttcagagctttaatcacctgaaggccctggcggctgccactgtcactgtcactgcctctgtcaccaccactgctgccacaggattgcctgtgggctagaacatgaaagtacaaagaaaagaagaaagaaaaactggggattcccttaactatcgctgagggttagtattcccttttccctcttctcaagtcagaaccagagctctctctgttcacaccactgtctacttctaacttgcaggctacgttgagccaaggatactaaaggggggaaaatgtcaaattcactgctgtttcagtggtgcttcaaattgtagtctttccccggtctgcctccttccatttacttttcagagtcctcaaatagctggcccatgcactgtgtccacattttatagctgcattcagtagagtgtgcatgcttcatctcacccaggagcagaaacattctggagatgttacattttacttttacatttaagtggaacaaatttgttcccttgtaagtaattgatgtgtgtgtgtgtgtgtgtgcacgcgcgcgtgtgcacgcgcacgtgcttaggtgtctttaatttaaagaatttaagaaattctttaattttttttgaagtaccataacacaactagaatatatctcaatattgattgttctgcatcaatttttgatggtagagactttgtcgttttgaggagcaggttcaattcttcctttatttctggaaacttttcacatatggcatctgtggatatttttctatcccatttattaggctctttacttaaggcatgtaaattatcttaatgttggatcagcattagcgtgaccatctaaagtccttcctccatgcccttgtttcgatttgtgtgcatgtctcttctgcatcttgctcttcctaatttacttctttgatccaccatgtggttctttgagttctcggtttcttttctgagctcagtaatctccttttttaaaaaaaaaaaaaaatcatattcggttgccaatcatctggtctttgaaactttgttaagttgaaatcatattttaaattttactatggcttagagaactctagggttagttgcatctgttccttgttttatgcattcttccagtctgtgatggttatctgtcttttgtatactatgatggtttctttctttctctttcttcttcctttcttctttcttttttctttcttcttctttctttctctttctatttccttatttcttttcttctttttcttccttccctcctcccctcttctctttttccctcctttcttccttctttcttccttccttcctccctccctctctctctcctctcttccctccttttccctctccctctatccctgtagattgttagcatcattgctaaaccatttatttttatttcaattatggaaaacattgtcagacgttctatttgctctaacattctgagggtgataatttgagggcaggtgggatgttgatttcaatctaccttttcttctaagatcttgctaaatatcatgtatcatgctctagtccatccatgcaagggtgtgtcttactctgagggttttgttttgtttgcccaactcagcacggtgtcttggaaaatggaaagaattgggagccttcctaccgctggtgaaatctaggagtggcagttgagggcttctgttcacaaaggtatttacttttttctgcttattctctcagtccatttctcctcaagttagagagccttacatcccattctcaggatctgactggctcacattgtttttcctcagtattgcttccagggggtggggacagaatgagaagtgtgctaaaccagccatcctccccacaagaatttatacatatatatatatgtactataaatatatagtacatatatatgtacaataatacatatatatgtactatatataatacatatataaatacatatataaacacctatataatatacatgtatatatgaatacctatatatttatatatatgcatatatatgtatgtatatgtatatatgtatgtatatgtatatgtatatatgtatgtatatgtatatacgtatgtatgtatacatatgtgtatatatgtgcatatattatatatgtatatatttatatataaatgtgcatatatttatatatataaatctgtatatatttatatatataaatgcgtatatatacatacgtatacatttgtatgtataaatacgtatatatttgtatatataaatacgtagatataaatacatatatgtatatttatatataaatatgtatatataaatataaatgtatttatacttatataaatacatatatatgtatttataggtatataactacatatatatgtatttatagttatataactacatatatatgtatttttagttatataactacacatatatgtatttatagttacatatatatgtatttatagttatataactacatatatgtatttatagttacatctatatgtatttatagttacatatatatgtatttatagttatataactacatatatgtatttatagttatataactacatatatgtatttatagttatataactacatatatgtatttatagttatataaatacacatatgtatttatagttatataaatacacatatgtatttatagttatatacatatatatgtatttatagtgaaatacatatatatgtatttatagttatgtaaatacatataaatatatatgtatttatagttatataaatatatatacgtatttatagttatataaatgtatataaatatatacttattgttatataaatataaatatatacttatttatagttatataaatatatataaatatatacttatttatagttatataaatatataaatatatacttacttatagttatataaatatataaatttgtacttatttatagttttataaatatataaatatatacttatttatagttacatacatagataaatatatacttatttatagttatatataaatatatacatatttatagttatatataaatatatacgtatttagatttatatataaatatatacgtatttatagttatataaatatatataaatatatacgtatttatagttatataaatatatacgtatttatattatataaatatatataaatatgttcatatttgtagttatataaatatatataaatatatacgtatttatagttatataaatatatataaatttatacgtatttatagttatataaatatatacgtatttatagttatataaatatatacgtatttatagttatataaatatatacgtatttatagttatataaatacatacgtatttatagttatataaatacatatgtatttatagttatataaatatatatgaatatatatgtatttatagttatataaatatatatgaatatatatgtatttatagttatataaatatatatgaatatatatgtatttatagttatataaatatgtatatgtattgatagttatatcaatatatatgtatttatagttatataaatatatataaatatgtatgtatttatggttatataaatatatgtaaatatgtatgtatttatagttatataaatatatataaatatgtatgtatgtatagttatataaatatatataaatatatatgtaaaatatatgtatctatcgttatataaatatatatgtatctatcattatataaatatatatgtatctatcgttatataaatatatatgtatctatcgttatataaatatatatgtatctatcgttatataaatatatatgtatctatagttatataaacatatatgtatctatagttatataaatatatatgtatttatagttatataaatatatatgtgtttatagttatataaacacatgtatatttttgtatttatataaatataaatacatgtatatttatgtatttatataactataaatacatgtgtatttatgtatttatatttatataaatatacatgtatatttatgtatttatatttatataaatatgcatgtatttatatttatataaatacatgtaaatatacatgtatttatataaatagatagacatatatttatataaatacatgtaaatattcatgtatgtatgtttatataaatacatgtaaatatacatgcatgtatatttatataaatacatgtaaatatacatgcatgtatatttatataaatacatgtaaatatacatgcatgtatatttatataaatatatatgtaatatacatgcatgtatatttatataaatatatatgtaatatacatgtatgtatatttatataaatatatatgtaatatacgtgtatgtatatttatataaatatatttgtaacatacatgtatgtatattggtgtaaatatatatgtaacatacgtgtaagtacatttatataaatatatatgtaatatacatgtaagtatatttatataaatatatatgtaatatacatgtatttatatttgtatctatatatgtaatatacatgtatttatataaatacttatataatatacatgtagatatacatacatgtgtaatgcatgtatgtatattcatataaatatatatatatatattcctgggaagccactttcctccctctctccctccttctcctgcttctcctccttagtcttctcttcttctcctccttagtcttctcttcttctcattctgctttttaccattatttatgtattattttttaatttatttagtaggatcggggaagggagattcttttatctttcttcactctgccatcttttacaaataaattgtaatgttactgactccaagttaagataaaagtttgcttgcttgaatgtgattattgctttgcttgagtttgtagattattcactaaaaatagtctcaggaaaacaggaccttcaacagagataaaagaaaacacgccaaccagcagctctgggaaggggctgaccagcctggtaagaataggctgacggtgcctgtggaaggtcacaaaacactgaccaagaaagcagtgattaactgcccacctgagactgaacacgttttagaagaatgttttgatcattatttcctctgctttcccttaaaaaaccctaatccagaggcacaactcagagaggtgatcactgaagtctagttcactgactcctcccggttgctggcttctcaaataaagctaactttcctttcaccaaagctcctctctttgagtttttggccttcaggtgatgaatggcctggaccggagttcagttacaaaatctctggttttgaagggttatttttttattcctgggatatattccggctgacttggagttagttttagataaatgtaagctttctaatggatctgaatccacactaacggatatgaaattatcaaggtctttttatttttaatcgcaaacacttcattttatcaaatcttaatcgtctccaatttcaccgcaaacaatgcaaggaccttgtcttacaagtcagtgctgtccagtatttagttataatttggtcagtcatattgtttttatgcagtctttttttttttttttttggactcatggccatggttactagtttctttgttcaccattcctctgttgcatcttgctttgttcttttcgttcaatttccttttaatggaagaacatctttaagtcgttctttcagtgagggtttgtgagtggtcagccctctcaacctttgttgaagaatatctttactggctgggtgcagtggctcacacctgtaatcccagcattttgggaggccgaggtgggaggatcatttgagctcaggagttcaagaccaggctgggcaacataatgagactttgtctctacaaaataataaataaataaataaatagccgggagtggtggtgctcacctgtagtcccagctactggggaaaaaaaaaaaattagccaggcatggaggtgcacacctgtagtcctagctactagggaggctgaggcaggaggatcccttgagcccatgagatcgaggctgcagtgagccatgatcgcaccactgtaccccaacctgggcgacagagtgagaccttgtctcaacaaataaataaataaatattttaaaatatatcaaaaagactatctttatttcactcattcttgaattgtagtttagttgggtatgacatttccccccattccccgaatgcattagtgatatgattccatttttattgcagttggtgagaagtctgctgtcagtttattatccctttgatagcactgtgtcttttctttctggttgattttaagatctttccccttttctttgttgacctgcgccggttcccctgtgattcagttttattgattcttgctgtggctcatgcttttagaatacgaggaactatgtctgttttcaaatctgaaaatttccagccagtatccttttgattattggtttacccctgctctctttattctctgattctgtcattcctattagagtttttttggacctttgcatcatttttctgtatctcttaaccgtttatacatttgctatctctccttgctgccttctgaataatttccttacttctatcttccagttcactaaagcagatgaatctgcttttaaacccatcctctgatcttttgctgtcactggaaataatgtctttcattttcggaagttctatttggttccttaaagaaagaaaccggcctcttctttttccgtagaatcttgatctttctcatatgtttggattccttattgtttctaagtatcttatacaaacttattttatactctcggttggctctattatctaaagtttttggtagtgtaatcctgctcatcattgtgtttgctgatactcaatcacaggcggtttttttttttcctcaggtgttttataattttgtttgtgagtttagggatttgttcaaacggcttcatctgtgtgacttcaatgaggtttgactgggggtgtatctctggctgttatctttttgatgttaatgtgtaagcttggggttttcaagacctaaataagaggtattaattccaaccctagacctacatgacaatagccttagagttacaaatgaccaggggaagcattttattttctcccaccagaacccatgaagaaacaaactctcttgtcatctcaccatggtggtgggaagacttttttttcctagtccatcctttcactgactgtgtagcccttgtgaggcaccaaggcttttctcctctccctggtggttattgaatccattcccctaccaccctaacataaattcaaatgcccattgatctgctctttaggttcctctttgttttttgacacctgagggtcaacttccaccataagttcatcacatgtgcattaaaaggaatatttattaaattttatcctgccttttaaaaggtgctttgtaacaggagggttttcaggttatctagtgtgcactgtttccagaaatggaaattgctttcccctttaaaactcccagagcactaagaagctcccacaaattctctggaagaggaatgtgatgggggcgggggaagacttttcatgaatatgtagcctcaaagaaagattggtgctttggggtgccagacactcaatgacagcttaagatgagtgaggaagggcctaggggttgaaagagccctaattgctcaaagccacatgtcacaagaaattttgggaagaagagccactttatgaactggttaccttcatggatttttcttccctaggctcagaagtggaaaaatatgaagatccattgctgatgggaatcctgccctaagcaaacggtggtgagacatggctgcttttagtgcatttattatatgtgaccatttaaaagcaggtactgaaggctgcagaaaagtcacgaggtggtactcaaaatatggttatataggtaactgggtgtggctcttccctgaggcacaaagaactgattttttttgtgtgctctttgaaaggaaatgtataaagttggtattatgctttactcagaaagtttttaagagggttgggagtgatgcaatcactttaaaatgatatacaaggttgaacactctgctaagcttcaggtaagagtatccaattgcctcttggacttccctgcctggatgttctgttccacatgcaccccaaactcaaatatatccaagactgaaaacatcttctctccaagctctctcctcttctaatattccctgtgtgaataaggtgtgcccagttgaccaaaccagtaacctgggagtcatcttgacaacttcctctccctcaacccctctctcgcaattaattggacaccaagttcagtggactctaccttcaaaatgcctctcaaatcaatccacgtctctccttggcattgctgtcgggcagcagggcccaggttcccactcctcttggaaatgacagaggtctcgcctcttctgcaccttcccccgagcttgaggatctatcctgtccagaagaaatcctttccctttcatatttctatagaatgctgtctaacactttgaattcccttcaggctctgggtttcagaaatcaacacagaaagaatgccgggctattcatttccctccaggatgaagttagaatcttgagggcagcgaggaaggcaggcatatgcattgttgcaaaccttctcaagtgattcagatgtgcagctccggtcaagagccactgcacaacgtggtgagctatttgaatacagggaccatgcctttcaactttgtattcatcaaaacacaacgcagccaatacctgatatagaatcagtgctcagtaaatgttccagtgaatgagtgaatacaagaactaaagaatgatatggtgcaaagaaatggatgaaagggatcttacgagctacttagtgcaatcccttcatttttttttttttcagttgccgtagcgttgggattgcttgaggctcccggatgttcacaggatgtcatttttggcaaccacagaccactagttacccagcttttttaggtgttgtgtagcaaggagggatttcgggttatgtaatctgcaatatttccagaaatggaaattatttctttttccttttatgactcacacaacgtcaggaaatttccacaaaattcccagaagaacatgatggaggaaaccactttccctatatatattttagtggaatatattttattttaatggaactgccagtgaagcagtagatgtggccagcagacactgctttcctggtgtctcctgagaactcttttctctcattggttattttcacctgccttcttctgcaagttcctttttgtttgggctcattttccattttctctgtatccaggtttgttgaaaatgcaggagccagtgcttcccaaccttccctactccaaacgcctatgcacacgcacccacttgcatgcgtgcacgtacacgtgcatacatatacacccacacgtacatgcgtgtgtgcacacacactcctggactcttgagaagctttcaaaaggaacttatagatagggtgaggacttttactattaattattaattattattattattacttatatctgaaatataacattttggacacacggaagtgctctaacccccaaattcctgtttgtctctggaaaggagcaggcagtctaggatgggcagggacacacaagacaacttatcttttgccatatgcattagacctaaagtatttacaaagcaaaagaggcagctgtggcgagacagaaaaagccctggattcagaattaaaacagctgggttagagtactggctctgtcacttgctctctaactctcagtttcctcatctgtaaaatcggggcaatggtactacttcatattaatacaacctcagctgcaaaagactggtttaggtacccttgttctgagctcccacagactccttgtgcttacctggtgttaacattggctgttaatacatgtgtctcccgtggtacaaggagatcttgagggcagaaattctatttgtctggcctccagcgtgcctgccctcagtgcacagcagaatggtcaatgaatgttggttgagtgaatgaagaacaatcggacatttgcatgtttttgtgtgtataattcctgttgtactatcatcggtagaccgccaggatagtacaaatctatttttattgtatgtaaatttgacatatagacattccaaattaacaggagttgattcgctccccatgttacctaacaactagtttcggaatgttgttggatccctttaggagaatatttcagtacatttgctcccctggttagggttaggggttagggttagggttagggttgtgttcccagcacaagcgtctcctcaataataagccttcacgtgtgtgcaccggcactttaaagagttgttgttgttgttgttttaaaggtgttttctcgtacactgacttatatgctcctcacgagaaccccatgagacaggcaggaaaggtgttcctgctaccacttgatggatgaagaaaccaatgttcagagacattaactgagtcactacacaccacatcaagagcaagtttgtttcagagctgggcctcaaacagaatcgggtttctcatttcacagtctggtgttttttacacaatccatttgttcaacccggctgcaatttgtgatgttgcttcagtgatattttttgcatctcatcctattcctgcttcacaactgcacctcctaccacttgcctcagcatactctcaaccggggcttctcaggtgctcaaccagggcctctccctctaccctgaacatgtcctcttgcaatttcctgcctctggatctttgcatctgttttcacctcttggtgggcacccgttccccacccccacgtcactgcaggttgaaagaaaccctaggcatcctctcggtttcaactcaaagaccacctaacttcatgaaacctctgcagatgggccctgctggatgagatctctctgcccttgaatgcacagagcagtccatgtcttgttctatatccatttccatacctgcttcattcccttctctacagtgtcccttgctccgtgttctcacagccccctgtgctcagttttcacagcacatattgccctatgttgtgagcctgctttcgtcctgtgactgtgagctccttgaggactggaaccttgtctgacttatctcggtatctccagcacgcagcacagtgccggaacacagtagttgctccaaaaaatgttggatgaatgagtggatggatgaatgaacactaccccacacaacgccttggatatagtggctgcaaaataataatggatcaaattgagtctataaccagatctcatttcttttcatcctatctcagtgaaagatgaaggtgctttcttctgactcaggctgtcacttccactcctgctctgggttcgatcccatcctgcctccccaggtgcctcactccatcaattacctcttctctcaagaatgtctaatctctccgtcttctctgcctggctcctttccttgcagtaactaaaatgctcaggtctctcctcctattccaaaaataagtaccctcaattgaatgggtgtcttcttcctcacagtatcaagatatgtacctcatcggggagtaacccagctgagtgagccctttactggggagccttcagtgtgagtctccttagatctttttctcttaggttggtcagatggctcacagaagactcttccagctgccagaagtttaggggcaggggcagggaagaagactgggagttcacagctttcaggacacatgcttccactcaacacccctgttttcagtacaggaccccagccctcaactaagtctgcgaactccccatccagagaccctctgctttaccctctccagggaataacactccaggcttctgtcagagcagggaagggccagcccctcactggcattgacagcaggaggggatttggcaatgaatctacttcttaaaagagttttcaaacagccttcattattttgatacccaccccccttcacttccagaggtaactccacttccagagttaccttggtccagcctttgaagattcctgggggtgaggagtaaatcaagttagctttttgcttttcccactaaggtctcagaattcctagtttgtggccttcttggatctgctaagtcagttgccactcatccatctgttcttcagcatccaaaatttagttgttgcctcctttcctgttcttcaaccctttttatttcatcttcactcctatccttctaatcctttcaaaaatcacatttgtagcagttccagtggggttttgggagatggtgaagttagatgtggaagtatgtgctccaccttaactatgcatcatcacgagcatgggtgtctgcctgcctgtctcattgattctacacaccttcattaccacaccactctccctaaaactctccagactcagcttttctcatctggctctctgacctgttccctgaccattctgttctttcagctctcagccttcggactgccaaaaccccaagccaacttcctatccaggaaccctccggcctagaagttcagatgtcttgccaatatatctgtgcttcacaacttgcctactctctctgacccctaacattttcacatacttttccaattctgcctgtcataaatttgctgcttccccctaagtagaatgttgattcctgtcaaacacacagcctagccctgattcctcctcttctctcaagcagtgatattgtcaacaatgataaacaactactatgtactgagtgtttttttatgtgctgctcacactttatacacatgtatagattcattcttcatcatagatttttcagctagctggcatttattagccccactttgcatatgtaggaacacaggctcaaggaaagaaagcaacttcccacaatttcccaggctagtaaaagtcagagatggaattcaagcccagatcattccaagtttgtgctcttcctgtgacacgacactgcctcagtcaaggcatcagagaggaagttagaaagcagatggtgagagggagtacctgaattggagggagtacctgaattggagggagtggccaccatcagtgggtagaccatggagaaagatggggctaacagagaaaaaccttcactgagttcacagttttacacagcattagcccttgtgatctttagtcgtgcaggggataaattaccgtgcctgcctgcccacacagaaagtaagctagaacaccactactaatctatatgatatacaccaacatggcttaagacgatttattgcaactgtaaaaaaatgcgcgcccccccccttttttttccagaaaggaagcgtggattgcattaatcaagctaaagacttttatacttctttacagtctgacacaaaaacagacagtcataaagataagcccgaatcatcaagaaagtgcacagtagtattttgcaaacccaatttagggaatcagggaagagtaaaatccacatggataaggtttccccttacttcccattcgtgatggtacagtgagttcatgttatggaacgcccactgctccaaacacatggcaatgatggacaaaatataaaaaggtaaactcaaaaaggcatggccaagacaaaacaaacaaaacaaaacaaaaacaaaagataattgtctccatgttgaagtactaggcttgttgctctggaagcaaaccatggtaaccagaagctaagctcctgcaatgtatagcggttccaaagtaccctgagcaagatggaagacaaaagccatactcacagattaaagcccaggactagaatggagctacccacaaacccaccaacccctgactgtaagtctgacaaaaaagaactaccaccaaactctgccagggtctttggttctgatgagctgcaggcttaaggaggtgaggatgcagacatgttctggtctcgtaactaagagttgagctaatccacagctgagctaagtgagtggatttccaatatgcccaagagcaccctggggccagtgatatggatatgttctatcaaagggttttgagcctaacaactgactggtatttttcaagagaaaaaacagtactgaataggttaatttccttccattcttggaagaggcaaaattagaaatgatgaattttttttttttttttttttttgagacatggtcttgctctgttacccaggctggagtgcagtggcgtgatcatagctcacagtagccttgaactgctgggctcaagagatcctcccacctcagcttcccgagtagctgggactgcaggcactcatgactccacccaactaacttttcttttaattctatttttttgtagaaacggggtcttgctttgctgctcaggctggtttcaaactcctgacctcaagcgatcctcctgccttggcctccaaaagtgctgggattacaggcgtgagccacggcacctggctagattttgcttttaagtttgaaatgctttatttagagtttattagccactaactccttttttttttttttttaaacttttaagttcaggggtacaagtgcaggtttgttacataggtaaacttgtgtcataggggatttgttgcatagattatttcatcacccaggtgttaagcttagtacccattagttgtttttcttgatcctctccctcctcacaccctctatcctccaaaaggccccagtgtgtgttgttcccctctatgtgtccatatgttctcatcatttaactctcacttataagtgagaacatgcagtatttggttttctctttctgtgttggtctgctaaggataagggcctccagctccatccatgtccctgcgaaggacattatctcattctttttcacggctgcatagtattccatggtgtatatgtaccacattatctttctccagtctgtcactgttggggatttaggctgattccatgtctttgctattgtgagtagtgctgcaatgagcatacacatgcatgtgtctttgtaacagaatgatttttagtcctttgggtgtagacccagtaatgggattgctgggttgaatggtatttctgtctttaggtctttgaggaatcaccacactgtcttccacagtggctgaacttgtttacaatcccacagacagtgtataagcattcctttttctccacagcctcgccagcatctgttattttttgactttttaataatggccattttggctaatattagttgggatctcattgtggttttgatttgcatttctctaatgatcagtgatgttgacctttttttttcatatgattgttggctgcatgtatgtctcctcttgaaaagtgtctgttcatgtccttttcccacttttttatgggattgtttgttttcctgtaaatttgtttaagttctttatagatgctggatattagacctttgtcagatgcatagtttgcaaatattttctcccattctgtaggttgtctgtttactctgttgatagtttctttcactgtgcacagctctttaattttattagaccccatttgtcaattttttgcttttgttgcaattgcttttggcgtcttcatcatgaaatctttgcccatgcctatgccctgaatggcattgcctaagttgtctttcagagttttcatagttgggggttttacatgtcagtctttaatccatcttgagtcaatctttgtatatagtgtaagcaagggagccggttttcatcttctgcacatggctagccagttatcccagcaccatttattgaaccgggaatcctttccccattgcttgtttttgtcaggtttgtcgaagatcagttagttgtaggtgtgtggtctcatttctcggttctctgttctgttccatttgtctatgtgtctgttcttgtaccagcaccatgctgtttgggttactgtagccttgtagcatagtttgaagtcaggtagcatgatgcctccagctttgtcctttttgcttaggattgccttcggtattcgggctttttttgttttttggttccatatgaattttaaaatagttttttttttctcgttctgtgaagactgtcaatggtagtttaatgggaatagcattgaatctataaattgctttgggcagtatgcccattttaatactgattcttcctatccatgagcttggaatgtttttccatttttttgtgtgtcatctccgatttctttgagcagtggtttgtagttctccttgtagagatctttcacctccctagttagctgtattcctaggtattttattctttttgtagcaattgtgaatgggagttcattgctgatttggctgtcggctttactgttgctggtgtataggaatgctagtgatttttgcacattgattctgtaccctgagactttgctgaagttgtttatcagcttaagaggcctttgggctgagacaacggggttttctagatataggatcatgtcatctgcaagcagggataggttgacttcctcccttccaatttggatgccctttatttctttcacttgcctgattgccctggccagaacttccaatactatgttgaataggagtggtgagagagggcatccttgtcttgtgccggttttcaaggggaatgcttccagctgttgtccattcagtatgatgttggctgtgcgtttgtcacagatggctcttattattttgaggcatggtccttcaatacctagtttattgagagtttttaacatgaagcgatgttgaattttatcaaaagccttttctgcatctattgagataatcatgtggtttttgtctttagttctgtttatgtgatgagtcacatttattgatctgcatatgttgaaccaaccttgcatcccagggaggaagccaacttgatcgtggtggataagctttttgatgtgctgctggattcagtttgccagcattttgttgaggatttttgcattgatgttcatgaaggatactggcctgaagttttcttttgttgttgtatctctgccaggttttggtttcaggatgatgctggcctcatagaatgagttagggaggagtccctccttctcaattttttgaaatagtatcagtaggaatgctaccagttcctctttgtacatctggtagaattcagctgtgaatccatctggtcctgggatttttttggttggtaggctatttattactgcctcaatttccaaactcattactggtctgttcagggattcagtttcttcctggttcagccttggggaggtgtgtgtgtccaggaatttgtccatttcttctagacttcctagtttatgtgcccagaggtgttcacaatattctctggtggttgtttgtatttctgtggggtcagtgataaatattccccttatcatttctgattgtgtttattcaaatcttctctctttccttctttattcgtctagctagcggtctattttattactttttttcaaagaaaaaaaaaacagcttctggattctttcattttttgaagggtttttcatgtctctgtctccttcagttcagctctgatttttgttatttcttgtcttctgctagttttgggatttgtttgctctcgcttctctagttcttttagtagtgatgttaggttattaacttgagatctttctaactttttgatgtgggcatttagtgctataaatttccttcttaacactgcctttgctgtatcccagagattctggtactttgtatctttgttctcattagtttcatagaacttcttgatttctgcctaaatttcattgtttacccaaaagtcattcaggagcaggttattcaatttccatgtaattgcatggttttgagtgaatttcttaatcttgatttcaaatttgattcttctgtggcccaagagactgtttgtcatgatttcagttcttttgcatttgtcgaggagtgttttacttctgattatgtggtcgattttagagtaagtgccttgcggtgatcagaagaatgtatattctgttgttttggggtggagagttctgtagatatccaccaggtccatttgatccagtgctgagttcaggtcctgaatatctttgttaactgtctgtctcaatgatctgtctaatattgtcagtggggtgttaaaaagtctcccactatcattgcctggcagtctaagtctctgtgaaggcctctaagaacttgctttataaatctgggtgctcctgtgttgggtccatatgtatttaggatagttagattttcttgttgaattgaaccatttaccattatgtaatgcccttctttgtgttttttgatctttgttgatttaaagtctgttttgtcagaaactaggattgcaactgctgcttttttatgttttccgtttgcttggtagattttcatccatctttttattttgagcctatgtgtgtcattgcatgtgagatggttctcttgaagacagcataccattggatcttagttccttatccagcttgctactctgtgtcttttaactggggcatttagcccatttacaatttaaggttagtattggtatgtttggatttgatcctttcatcatgatgctagctggttattttgcagacttgcttacatgtttgctctgtagtgtcactggtctgagtacttcagtgtgtttttggagtggctggtaaccatctttcctttctacatttagtgcttccttcaggagctcttgtagggcaggtctggtggtaacaaattcccttaacatttgcttgtctgaaaataatcttatttcttcttcgcttatgaagcttactttggccagatatgaaattctgggttggagtttctttaagaatgttgagtattgacccccaatctcttctggcttgtaggttttccactgagacatccactgttagtctgaagggcttccctttgtaggtgacctggcctttctctctagccgcctttaacattttttctttcgtttcaaccttggagaatctgatgattatgtgtgttggggatgttcctttcgtggagtatcttcctggagttctctggatttcctgaatttgaatgttggcctctctagctaggttagggaatttctcatagatgatatcctgaaatgcgttttccaaattggttccgttttccccatctctttcagggacaccaatcagtcttagattcgctctctttacgtgatcccatatttctcggaggttttgttcattgcttttcattcttttttctctattcttgtctgccagtcttatttcagaaagccagtcttcaagctctgaaattctttcctccgctttgtctattctgctattagtacttgtgattgcattatgaaattcttgtagtgtgttttttcagttccgtcaggttggttacattcttctctacatgggctattttgtctgtcagctcctgcaatgttttatcatgatttttagcttgcttgcattgggttacaatgtactcttttaactcagtgaagttcatttctatccatattctgaattctacttatgtcatttcagccatctcagcctcagcccaattccgaacccttgctagagaggtgatgcagtcatttggaggaaagagggcactctggcttcttgagttttcagcattcttgcactgattctttctcatctttgtgggcttatctaccttcagtctttgaggttgctgacctttggattttttttttcttttaacagtctggccatgtttctgtagggctgctgtactttgctgggcttcttctccagttcctagtctccttggattttccagtacctggagctatcaccagtgaaggctgtgaaacagcaaagatgtcagcctgcctcttcctctgggagctccggcccagcgaggtacagacctgttgccagcccaaatgcgcctgcaggacaaggctggagaccctggttgggaggtctcacccagtcaggaggaacgggatcagggaactgcttaaagaagcagtctgtccatgctttcacagatcagctgtgctgtgctggggcactgcttccacccctggttggtgtgggctctccaaagcctggaggccggaacagctaagtcgcccaaacagcaaagatggtggcccctccctccctccgggagctctgtcccagggagaattcaaatctctgtcagccagagaacaccagtaggggttgctggaggccttggttgaaaagtcccacccagtgaggaggaacagattgggcacctgcttaaagaagcagtctggccatgcttctgaagagcagctgtgctgtgctgttctggggtaccacttctgggagctctgtcccagagagcagcctgcccttccccctgggacctctgtcccaggtaggtgcaacactgctgctggtggctggctggaattccaaaccagtgggtcttatcctgtgaggtgcagtggaagtggggcccgcagatcgtgccgcttggccccctggattcagcctctttcctaggggtatgtacaggggtctaatctcccgctttgcaggagttgcagttacttttgctgggaaacccagggccggagtatgtaaagctgctgggtctctgcacgtgctcaagcggctactctgctgagactccatgtatctctgtgtgtcagactgaaggccctggtggagtgggttcaccaggggatctcctgacccaagggttgcaaggatccatgggaggagcgtggtttcccaggatcgcacattcacttacgacttccctgggtggaggaggttcctctgtctccatgttgctcctgggtgggctgtcatcctgccttgcttttcttcattctctgtggatcgagttgtttccttgattagacccaatgtgggtacctggatgtttcagttgaaggcgctgtatttactcgcccctttccttcccctccatgagaaccactcaccctagctgcttctagtcagccatcttggccactccctccccgccccccaccttttttttttaaatgcttgaaaactatttgcaaaagaaacctagagattctcatggttcttttaagatcttgttggatggactgtgaaagtgggattattgtctatgaatggtcagctagactgtgtgtgtgtggaaagggtgagggaattaacatttattgagcaaaagggcatgctagttaaaatcattgtctctggggacagatttttctgggttttaatccaaactctgacacgtattagccgtgtgacctctatttttcatttgtaaaatggagatgggattgttgcggggattaaaagcacttacaacagtccaggatatagaaagcactgtgtaagagctggctgtcatatattagtcatcagtcatcatacttaataatcacaaaattgttagaaaatcctgtgaggtaggtattttccttaccatacccatatgagaaaacttaagcaaggagaagtcaaacaaagttaccaaagtcacacaattacggagtgacagagcctttagacgctgcctagtccaaggctttcatttcacagaagagaaaactgaagttcaaaataggagagggacatgcctgaagtcatttagtgagccagtgacagaactgggcctagaactcagcagcaggactcttcctgtcagtagttctcaaactttgtcatgtgttacaatcctgcagaggacttgctaaaacaaactgctggtacccatgcctagagtttcttacttagtaggcgtggggtgggccttgaaaatttgcatttctaaggagttctcaaatgatgccactgctggtggtctggggaccctactttgggaaccaccacaacacaccataattcatacatcttttgttcttttcatcatggactacacagtgtgtgacctacaaacactttcaaagaaatgggaaccggtgatgaaaaccaaagaaaattacatatctagcagcaagaaggtacggtgactgaccaacagtcctggtttgtgtgggactctcctacttttaaaatggaaagtcctgtagttctgggcacaagaggatggttggtcactctagatgaaagcaaacaaaagtcagtgtcagctaaatgccaaacgaaaaaggacatacatacagagaatgtggtaacttctggtgaatttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataa

SEQ ID NO: 1944 - DNA, 100 bp, Homo sapiens; identical to SEQ ID NO: 1937

SEQ ID NO: 1945 - DNA, 71139 bp, Homo sapiens
cactctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtaggtcaaatttgtgggaatcaagcatatttagaaaccctaacctcaggctctgcgcatctgtgggtgtctgtaggagggatacttaggtttcatgcctgcatctgcgtttcctctcctctgccgctaacattcttccactgagcacatgtccatcttgagctggaaggtttagcggtttgccatcttgtcttgcctgcagttatgatgcagctaaagcatccttctctccttcctataacctatgccactttgctttaagcattgagtatatttatgtctcaggtttatgaaagacaattataaaatctcaggagaccatcataagctcctgtaatatcttgcagtcctgagtcacccacaattattttttaactggctaggaaaaagaatgctagcgattttttttaaatagacattcagtaaaactctagatatttcttaatccacatttactgtgtcctttttgcttaagtcaggtgttttggtttctctagcagctgcaggatccccataaagattatgctcataaggtagtgatggaaaagtaaaatagagcctgaaagcgggaaacttcagcaaggcactaaggcacagacaagagatgttaggtctgccggctgttgtcattgcagtctgctgtggcctcacccccgcccccccccccgccccgcccaggccttcacagctgagtaggaaaggatcttgggatgggtaccagggcaggatcaaggaaagcctgcaactgcgctgcccttctcatcatccatatgtggtttgcccagataaaagcaatatagtaagatctatcaggcatattcaacgtgagttcttttttctagcatcttgttggttgtttgtgtttttccccagagaagagtgagtgatgaggtggccctgggacatggtagatggtgcagttcactggggagacatccttggccccactcagggtcaatatgcgccccacaccgctggctgcaaccccaccctgtcctcttctgctcaaaagagcatgcaagggacattgctaagtggcaattttggttgcaacccagtgttctgttaattattcacaaaagctagctctctttttaattaccaattgtgtgtgcgttgcgtgtgcgtcccttcccccttctctgagcacacctgtatgatgaggcatgtacttcttcctggtggagaagaactgcagagatgtctcccaggttgagcctgcagcctggcccggtcaccagcacagcacggtgacttgactgtcctccctggctcccttccccacccgtggcaagtggcaacttgctttcgctcacactgaacgtggtcaacttgcctccctgtcacactgtagcacttgaatagggcaatattagattatagcagaggttctcagacattagagtgcttaaaaatcacctgggaagcaggccaggcgcagaggctcacgcctgtaatcccaacactttgggatgccgaggtgggcggatcatgaggtcaggagtttgacaccagcctggccaacatagtgaaaccctgtctctactaaaaatacaaaaaattagctgggtgtggtggtgtgcgctgtagtcccagctactcaggaggctgaggcaggagaattgcttgaacccaggaggcagacgttgcagtgagtggagatcgtgccattgcactccagctggggtgacagaataagactccgtctcaaaaaaaaaaaaaaatcacctaggaagctgtttaaaatttacccttcttgtccgtatgccctatttgctgggtctgaggtgggcccagaaccctgctttccagaagggagcctgagggtggggtgccctgaagaccacactcaggaagaaccggacatgtgagctttcatgagccagagtcctgccaagaactagaatctgcaggtggctttggccagtcccacttagaggcaagaagacgtgaggatagtagagaacctggaaatcacgcagtccccaggatgaaagtggaactctcggaccagatccttattctcttactttcgtgagccatttctgcctacctgttgtcagggaggcaggaggttcatttttctctcacatggtgcctgacataatgacttgcacgtgatagatgctcaacaagcatattgaatgaatcaatcagttagattgtaaattaaatgcaccagatgggctggttgtttatttataactacacagttaacatttatattaacataatgttaacaccaaagcgtaatatctgttttctgtgttaattatggcaaggtgggcatagagaagagatttctgagtgtcttttgcagagcttgaaaatgtctatgtgttggttgagatagatcagcctttacttgatgcactttcaatcttttaagttctgaaggcacagcaagagaatttggtgttgaaggtttggataatgttttcaagtatttcaatatccctctatttctaaacattagtaaaaatcatgcctcatgctaccatccttagcttcactttgtgtttctgaattgtgtatctctatatactaagaagtcccccatgtatgcctgcaaatatgggagagtcaaccgctcagcagaatgtgcacaatgtaaggctgtgccttggagaccaggcaccctgtgcagtgtgatgcacaggcaggcctcaggatggcgccgtggagggcaagtgatacctactgacgaagccagtggagtggatgcaaggccaactcaggccctgcagctggggttctgttcctcagtgttgaggccacaggtctgtgtccacatgttttcttttgtacagtgggattctgccgcacaaggcagtgcccccagccctttgcagatgagtcaaacatgcttgtttgcagagcctggtgctgggtggggtggtcccatcacatcacctcttccttggtcatttctctgtaattaatcagccagtccctgaccaaaccagcaagatcaattctccctctggttggactcattcctcttttttttttttttttttttttgagatggagtctcgctctgtcgcccaggctggagtgcagtggcatgatttctgctcactgcaaactccgcctcccaggttcatgccattctcctgcctcagcctcccaagtagctgggactacaggcgcccaccaccacgcctggctaattttttgtatttttagtagagacggggtttcaccctgttagccaggatggtctcaatctcctgaccttgtgatccacccgcctcagcctcccaaagtgctgggattacaagcgtgagccaccacacccggcctcctctttcttatgaaaattaacccacagatgaagtttcctttcacccaagtcttgacaattttctcagcttcaagctgcagaggaaattcctaggcacatcttaacagggctgctttgcattgagggggctgtgtggtttgagcgtgataagcctggatatctttctgcactatgctgatttttgttcccttaaatggtatggatttggcaacaattgtttgcaggtgatcttttcccagagaaccacttatttcccccactgtctctgtatgataggagggctctaatggcccagggatgtgaaagtgagacaccttcaatcgctaaggactgctggaaatgtgaactacaggaagttgagggggctggaggggaggaggcagcacctgccggagccatgcttcagtgggtctcaagaaaagcagaagcctggaatctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttccccaggagcaactgttcaggatttgcaaattcagctttcatggtgattttatagagcataactattgtgaataacaagaagcaactgtattttgtttcatgcataagatggaaagagaacagaaccagaagtatgatatcgatgaaatggagagaggagaaagaaaagaaagaaatgacactatgaagatttattagttaaaatgttactagtgataataaattaatcagaactttggcctctgcctttgatcctggttcccataatctctaagtgccaggctcagataatgtggcccttgcagggtttgggcagctagtcctctaaccattttctacaggtaaacgtggacatgaaagaagccagggtgaggcaggcagcttccagaagcacacactgggctcagctccttccttcctaacctctattttagctccacgtacctcttcaataccagaaagtcttcttctgattctgccagagcccagctcctagaacctagctcatacactcaccagccttttttgtcaacaattcattcaaatatttatttacttaaatatccattaagcactgttgcttctctcgcccaactccattgcacatgctatatcagttatctgttgctacataacagatcactctaaacttagtggtttaaaacaacaataattacttattattgctcataatttctgtgggccaagcatttgagatagctgggtaggctcaggccctctgtagggttgtagtcaggtgtgggccagggctacagtctcatctgaaggcttgatagaggctggaagatactattccaaggtggctgctcatacggctggtcacttactgctggctattggctagaggcctcagttccttaccacatgagcctccccaaagagctacttgagcatctttccaatgaggcatctggtttccccagagtgagcaatccaaaagctgaggaaaagtgttaagggctttcatgagctagcttcagagacccaacattgtcactctgcagtcagccactctgtgtgcaagggatgggagtaccaggaagtgaggatcactgggcaccatcttggaggctgcctgccatgtatacattttaactctcaaacaaaatttgaagactgaagacccatacttaaagtagcctctgttccaggcagtagagaacaaaatgtaaacgtacttacactaatggagtgtctattctagtggctttggggaatatagacaaaaaaacagaactaaaactctaaggtgggacagggagctgggagtgttagtgtcaggtgggcctatagagctcagccccccttcatcatgttggcattcatgctggctgttcctctgtaggggatgaaattttcccctgccagaagaatgggctctggacagcttgttcagctgcttgctcaggtgtgagcatctgtgcctaatcttccagtcagactgccctagaaacatcatttcttaattagctgaaagggtatctgaaacattgtacttatggtggcaagcatggatctattgctcttcatctataaagttgctgcctgataaggtagaactacacaaatgatagtttcccaactaaatgcattttaaagggcaaaggttgtatagtcagctttagtcctggcataggggaaatggactatggaagtctagttggaagagaagattgaaacatgccagtaagtgcaaaaggatacagtataatttaaataaaacacatggaagacatgaggatgctagtgggatatgatgggctcatccatttctgcaggctccaggagggtggctggcagggcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttccttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttttgttcattggcaatgatgttaacaaattaaataggggaatatttgttcatctaatttattggtaaaaaggctagaacaagcttatccaacccatgacccataggccacatgtggtccaggatagctatgaatgtggcccaactaaaatttgtaagctttcttagaacattatgagatttctttcccttcttttctgtagttcatcagctatcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttcccttaagaggccaggagcttatgtaggaaccaagctccatctgaagcagccacagggctggagcatctcgcagattagttgccagggttctctgattctggccctgttagcctccatctggacacacagcaattgcatgtttagcatttttattacaaaagcaacatacaattttgacccttgaacgttacaggtttgaaccatgtgggttcacttatatgcggattttttttcaacaaaaatattggaaaaaagttttgaaggtttttgacaattttaaaaacttgcagatgaactccatagcccagaaatataaaaaatgttggccgggcgctgtggctcacgcctctaatcccagcactttgggaggctgaggagggcagatcacgaggtcaggagatcgagatcatcctggctaacaaggtgaaaccccgtctctactaaacatacaaaagttagccaggcgtggtggtgggcacctgtaatcccagctacttgggaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagcaacatgtttccatcaagcaggattttgccagcctctggttaaaccctgaagcctgagcaaggcagtgaaatctccagacctttggggctcacattttagggaaagggcaggtttgtgttgatgctacaaaggtaatagatgcttttgagaagttaactatgtgcgggggtggccaaggtaggccgaagcagcacctgagactggatcatcatgatgcaactctctgagtaaaggcctgagaaggaggaagccaagcaggaggcaggagaggcctcaacctggaggcagaagcacagtgtggtggagatagtgagcaaggtgaggttgcaggtctcgggcctggtcaaggagagccttgtggaggagcaatgaagatttgcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcactgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaatatttttgatgacttattctgcactaggagctgttccaggcatggtgatatggcagtgaacaaggtcatcctattctcacctcccagagctggccctctggtgggaagaacaagacaatactcaaattcaacagtgaatcatgatttaaagggctgctgccttatggagatgtgctgcagagaaaaattaggcagggaagggaggtatgcggcccaggacattacagaagattatttcatgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgatgctcttacattttatagccccttgtaggatagtgcatgttgagaagaagccgcttcacatcatcgtggtgcaggatctgtggtgtggtgtgcttcatgtgtgtgttttgtgtgtgtagtgtgtatgtagtgtagtgttagttgtgtgtactatggtgtgtgtgtggcatgtatgtagtttgtgtgtggtgtgtgtgcagtgtgtgtgatgtgtgtagtgtgcatgtagtgatgtggtgtggtttgtgtgtgtttttatgtgtagtgtgtagtatgtgtgttgcatgtagtgtgttgtgtgtcgtgtgtatgtagtttgtgtgtgtggtgtgtttgcagtgtgtgtgggtgtgtactgtgttatgtgtgtaatgtgtatgtagtttgtgtgctgcacgtagtgtgttgtgtgtactgtgtatgtagtttgtgtatactgtgtgtagtatgtgtgcagtgtgtgtgtagtttgtgtatgacgtgtgcagtgtgtgtaagatgtgtgtagtgtgttgtgtgtgtagtgtgtatgtagtttgtgtgtgtgtggtgtgcgtttagtgcatgtgtggtatgtgtccatatgtgtggcatgcatgtagtgggcatgtagtatgggggtgtatgtgtgtggtgtagtgtgtgtgatgtgtgtagtgtgcatgtagttgtgtggtgtgtttcgtgtgtgttttgtgtgtgtagtgtgtatgtagtgtagcatgtgtttagtatggtgtgtggtgtgtatgtagtttgtgtgtgatatgtgtgtagtatgtgtgatgtgtgtagtgtgtactgtgtgtggtgtgtatgtattttgtgtgtgtggtgtatgtgatgtgtgtagtacatggtgtgtgtagtgtgttatgtgtgtagtgtgttgtatgtggtgtgtatgtagtttgtgtgttgtgtgtgcagtgtgttatgtgtgttgtgtgtgtagtgtgtatgtagtctgtggtgtgtgtgatgtgggtagtgtccgtgtagtacatggtgtgtgtagtgtgtgtggtgtgtgtagtgtgttgtatgtggagtgtatgtagtttttgtgtgttgtgtgtgcagtgtgtgatatgtgtagtgtgttgtgtgtgtggtgtacgtgtagttggtgtgtgtgatgtgtgtagtgtccatgtagtacatggtgtgtgtagtgtgtgtagtgtgttgtatgtggtatgtatgtaatttgtgttgtgtgtgcagtgtgtgttgtttgtagtgtgttgtgtgtgtggtgtgtatgtagtttgtgtgtgtggtgtgtgtgtgatgtgcatagtgtgcgtgtagtgcatggtgtgtgtgtagtgcagctgtggcatgtgttcgtagtgtgtgtggcatgcatgtagtgtccatgtggtatggagtgtgtgtgtgtggtgtagtgtatgtgatgtgtgtggtgtgtggtgtaccgtatgtgatgtgtgtagtgcgcatgtagtcatgtggtgtgtttcatgtgtgttttgtgtgtatgtaacgtagaatttggtgtgtgcggtgtgtttcatgtgtgtggtgtgtatgtagtttgtgtgtatgtgtatgtgtgtggggtagtgtgtgtgatgtgtgttgtgtgcatgcagtggtgtgtttcatgtctgttttgtgtgtgtagcatgtatgtagtgtagcatgtgatgtgtgtagtgtgtttcgtgtgtgtggtatgtatgtagtttgtgtgtttggtgtgtgtgatgtgcatagtgtgcatgtagtacatggtgtgtgtgtagtgcaggtgtggcatgtgttcatagtgtgtgtggcatgcatgtagtgtgcatgtggtatggagagagtgtgtgtgtgtgtgtgtgtgtgtgtgtgtgtgtgtgtgtaccatgagggacatgcgctttgctccctggataaatggatggagtcatgtagataattttccattcacgaccagccccttttggttaaaatgtgcctccttggatacttttggggctggcaatatgtatccttctagtttacaaccatgattgagagggaatactctccatgttaaatatgcattggccgcctttctttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccagggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagattctgcctcctgtatgctgctgggaccctgagggtcagcccaagagtcctgttttgcaatagcccttctgtttgcttctctttgcggtatgtttatttttagaattctttgtctttccccactccccccaaaaaagaattatttaatttggtcacttccatcaaatgctctgattttagcttagttagaaggcatgctgaaaactgtaatgatgatgtgaacagaaagacaactgtgtgttgggagggccaaagagggaagtgcctttgttcagagatgggagggtttgtctccactttgaaagggtttgagtggttttagcaaacgttccctgccacgtggggtcctcaccaaagttctctgtctctgtcttgcccaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggtgggccacagctggtcctgctccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccatgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattccactttatattgcagttgtccagttatcaccccataattgccaacctcccagataatagcttccaaggctttctcccttgtgttgtccacagctcagtcccacaccttcccgtgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagtgctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccctgcatttcagtgggagaaaagacgctgaacaataggaaagaactgcatttaagtaagggcgtagagcacactggggtatggatgctgggtcttctttctgctgcgtggggaggatggaccttgctgtgagggaggccattgagaagaggcctgaaggcagcgaggaaccatccccacccagggaatggcaaattcgaatgccctgtggcaggagcgtgcctggggagcagggcacccacagaggccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttcaccccactcctgcagtggcctggaccacacttggatacatcagtaacatacactgaaggtcaggtcctccatgcaaactctttccatccctgcatcacaggtgtaccatgacctctgcaggtgagtcattcttctgcaggtgagaaaaccaggcaggtcccccttatccttcccttctcttcttcagtctgcagtaggtgtgtttatttccactctgtggctatgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccaggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaagtggcattggtaagaattggactaaaaggtaaaaaaaaaaaaaaaagaattcctgaaatgcatgcacctccatagccatcacaaaatgcctttgctcaaacagaccttgaaaacactgagggtaaggcagcatattttggagatcaaaatctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatttttagaatccttgtcaaatttgggaggggaagataaagtagaacagagtgagcttccctggctgtgactaaaatatcttttgcaatctgtacaaaacctaaggccgtgcagtcacattgctgggctcctcttggtctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacacataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcaaagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcctgcagggccacccatggagcccgtaacttaagatgcacaaatgagctattgagtgaatatgtgtgtgtgtgtgtgtgtgtgggtgtgtgtgagagagagagagagagagagacagacagagaaaaagaaagaaccatctggagggctggcaaaagcacagatgtctgcgttccatcccctgagtttttaattcacaggtctgtgtaaggactcttccatttgcattcctgccaagttctcaaatgatgctgatgctgctggtctggggatatggtgtgagcctgtttgagatacctgttacctacctgggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatggcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaagaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagtagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttaacttcatccttgagccgtctatgttaacacacgtaattcacaggacctcagctgtctcctccctccagcctgttaggaagtcaggtacagatttatgctctaagcaggaattattttcctgctcttttcttggggctacatatggcctttttttttttttttttttttttttgagacggagtctcgctctgttgcccaggctggagtgcagtggcgcgatctcagctcactgcaagctctgcctcccgggttcacgccattctcctgcctcagcctcgcgagtagctgggactacaggcgcccgccacaacacccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcgtggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtccgaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccacagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttaatatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacacctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctaaaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcaggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttcttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtgaggagggtagagtttaaaacattgtgatacaaatgcaaaaactttgaattaaaaatgaactcgcagtgggggagtttttgcatttaacgttgatgctgatctatgtacttctgtcgattcttctttgtggtgtgtgtttaacagtgaggagtgaaaggtgggtgggaagagagcagggtgcgcagccaggggcaccacctcccacttggctcccaggtgggtgcagtgaggctgctgaataccctttgggctcgtggtgtattcttgtgactcaaggaatcaggataggggctgctgggccgacctctgtcctccatggacgcacgtaacagtgggcagttatttccagagtggtccaccaggggcagaccggggagggaaagcagtctacgtgatattcactggatgttcaccagaattacagcaaagtagagcagtagaacagtctccttaagagagtattctttctaaacgtattttcccgcctggagatttaagatggaacctgagtgaggttcacaggcaggcaatgtctttccccttggttcccaccccagtccgctctgcaggggtgcatttcagtgagttctgcaggcttggaggagtcagctccagggcacaagccccagtcaaaaggaaatcatgacaatggcccatgccccatattagaaatcacagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttgaatatccctggctccagggatcccttttctattgacacagctgccggcatttacctatgtgagcttttagcttgcttagctatgcttgcagcttgatttttcaggctgctttttgttataaaagacatgatttaggagctgctttttattgcaaggaaaccttacagaggactctgttaccctcactatctgcctaaataatttctttctagctctgaatcactttgtctaaacataagaaattcaatgaggtgcagttgaatgaaaaaaaaggaaaagattccttggagcagggccacaaggagaactcagaagcgccaagggctggtcctggtaacccaggctattgcttgaggccctccagaagatgcagggggtccctcactgcaggcattgtcatcagttccagggtgtggtcctggagggaattcaaagggacttcccagcctcaatgacaaagccctgagaaggcagacagcatccctcacccttgtaagacagccagagattacctccaacccctttttagtcttaatggactcttcagctggacctagaaaccaaattgataccaggccagattaacaaaagaaaagcttaccaattttactagttttacatgtttatggggatcctcacaagacagtgaagtctaaagaagtggccaaaacaacatgcttttataatctttagacaaagaaccatacatttaaggagaaatgacaggacaaataaaatctggctagaaggagtaaattttctagagaaggcgctaggagatatgaggagggtgtaaaaccagtggaagataagggatactgtgttaaatatgtttactcaggcccattgcagctccaatgcccagtctctgatgataaggggcattttctcatcctgctacaggaagggtctccttcccagaggaatctttatggcttgctgcaggcatgaagagacaggtcagttagtcctatccgaaactacaatgtatccaatattttcaactcaaaataatcaatatcccaatctggcatattttgggatggcccatgcttcactccttccccctctcactttccaaagaggaaacacaacatcagagtcctgccctgtgcaggtcactcaaggaggcagcgtgaaagccaggaaggaaacactggccctaagaaaagcaggaatcagtcaggaagccttccactgtagtgttttccagagccaagtcatgcttggggtgattaaagacaccagtggggaaagcccttgcaaatggagagaagttggtgctcttgatcctgaaaaacggtttcctaatagtcccagccctccagtgggggcctctgccgaatggagaaatttcctgggctctccaggttctctgagagtcagggaggctctagatgcggctcaaattcctgtttaaagatcaacaagcccaagataaaacatgaattcccaggaccttggtgagatgtcccctggctccctgcacaacctcagctccaaggctttcctctgagcggcacatcctctgagagccctgggtcattcacagggtcggtggccactgccggagctcctgctatgcaggctgccaccccaggtgcaagcctcacagaagcctcagaccctgtccctatcagaccttatagttggggctggggcagacaggcaataaacaataagctaaaaataagtgtgtcctatgatgtgtcttaggaaagggatgactccagtgggaattctaagcaaggagggcacaggggcctggaggatatcacgtgtatatatggggttttttaagccctctcgtgtcgaagtagtttctcacagttgcctgcagcacagaagcacattggagcttctagaatgtggtggattcaatgaagggactacaggtggtcctagtatattctctgttttgttttgttttgctttgttttttcattttttcctcagtagtaaacagccactctctccaaggtgatatatagagacagacagagagagcgggagggaggtagatgaagggagagaaggagggagggagggagagaaatagtctcattagcacaaacccaggtatggttgaagggggtttattatgagtaacaaaagatgctgctttcagcccaacaatcaggaaattccaagggttttaggagctctgtgccaggaacccaggataaagaccatatatctctttatataaaatcacacactggaaactttaaaagagaacagaaaattatggggagggaagcctcacacttccagcaggggctccagataggccgcctttagggattgcagctgagacctgcaggctaagaagcaaggttgagtgcagggatgaggggagaggaggagggtcactgggtacaaggagcagagcagaatctgcactctggcccgaaagcagagtggcaggccagggcaggccaggaagctgggcacgcaagggcactgcatcaccctcctgctgctgaagcacagctgtgtcccagcttcctggaggcagcatctcccatggatgtacaggagagatttcctaggagacctgaccaggtgtttttcctgaggacgagtctgtattcctgtttccctgcatttgtttgctccttggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatccagaaatcttgcaaaataagaaaaataacttctaagtgaggatcgattatcagggttttagtacttacttccaactgatctgtacaggatgtctgtgtaagacaaaacagaagtgtctgtaagtgtttgtttagagactgcgaactgttaatgcttttgcccatagtttactgacattagtgcctccctggccagcagtggcagtaaggactggctatattaaggtggatcatagacaagccctgggtctttgctcctgccatgacatgttttgagctttcctaagaacccatatcaacagcccattttcagaaaatccagagccatcgattagagcgtggaaagggagaattaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatga

SEQ ID NO: 1946 - DNA, 216843 bp, Homo sapiens
cccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtacatttgtcttgtgtatttgtcttcatttcacatgtccatagtaaatatttttacgtgaagttatttataaggaatagtaatttaccagtttgtgatcatctctttcatcatcattgttctctacatatgatattattagctcttattttcagatagtctcaagcagattctcagtatacagcagataagtttttaatagtcaacacaattattttactttcataccatatcttatttcacaacatagttattttaactgtttttagacaagttattttggtcatttcatttcaatccacttttttctattttgggctaacatttttagtttatgggaatgtaatttgctacaaaatattaggaaggaaatatcttcagaagatagcattttccaatgacagtaaccaatctttcctgagagctaagcacttgcagacactaatttatttctagccacaataccatgaagcacatttttagagatgatgaaattgaaaggcagagaggttagtgtacttgttcatggttgtagaattggaagaactcaagtctaagtctgtcttgtcccactttcaaatgctatcatcttaaacgggctcttccttatgctttttgatatatgtattttagtcaaaaactagttaatttgtggttgacttatgttctttattattaacttaacacacttccatttctgccagtatgacataatgaagcaaaattttttaacataattgagccttaaaatgtgtcttttcttttagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaaaccagagtcaaatttgaaaataattgttccaaatgaatgttgtctgtttgttctctcttagtaacatagacaaaaaatttgagaaagccttcataagcctaccaatgtagacacgctcttctattttattcccaagctctagtgggaaggtcccttgtttccagctagaaataagcccaacagacaccatcttttgtgagatgtaattgttttttcagagggcgtgttgttttacctcaagtttttgttttgtaccaacacacacacacacacacattcttaacacatgtccttgtgtgttttgagagtatattatgtatttatattttgtgctatcagactgtaggatttgaagtaggactttcctaaatgtttaagataaacagaattc

SEQ ID NO: 1947 - DNA, 109741 bp, Homo sapiens
caccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 1948 - DNA, 104725 bp, Homo sapiens
caccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataa

SEQ ID NO: 1949 - DNA, 100547 bp, Homo sapiens
caccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatg

SEQ ID NO: 1950 - DNA, 214778 bp, Homo sapiens
cccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaagaaagaaaaaaaaattctcctcatttttgttgttttgaattttcagtgatgaatctggagtggttctttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaatgaaaattacccacttctcattagccctctcagatcatcttctttgtggtgggtctgtatttgactcatttacatactgccattccaacagaatctctatagagacaagagagaaacctgttcagtcagccatcttgaatcagaataccatttctgtttataccttaaaaatcagaatcttaaacatatattgaatttttgttgtaagaaaatgtgttatgataactcattagccttgcttttcttccaattcaaattttagagtgtaaaagaactattacctttcttactttgttttgcacctttttaccttagcatttctgcctaatttgttaaatttcttctaaatccaaatcacctgggtttttcccttaaagatattttaagcctctttaattcattttcaatttgttccactcctttttattctttattttacaatatttttctcattctctgttttttgtttgtttttatccagccatgctcctgtgtctacatttatgccagctttcacaagagtttactccatttaacaacttcctttagcggggctaaagctagaaacaaatagatttttccttgggatctaaaaactatcttagattccccagtcagccctaggcctccaaataaagcagctcaataacccgtggcctcccagaacaccatcctcacagatctgaatcagaagcatccctaaagttgctagatggccttccaaatgtgtggaagagctggtgcattttcgagttagaagttctgtttagaagtagccatctcccctatgcccagaaatgcacattactgggcctagaagtgtgtatttcactcccctaaaaatgtaacctcagttttgtttattttcttgttccttatagccctcaggttatgaggaaccaggagagagtataaattaatcagctgaactttgtcacagcgagtagtaaaagggaaacaaagaacatgttcttctgcctatttgtgtttgggacaacctttcatcttctgttgtgttatagaaagattgttggactagaaaaaaagaactaagtcagggtcctccctctactctaattagccatgtaacctttagcaaataatcttggcagcctcaattgctttgtcagaaaaaagggagacacttggaccatataatttctgagatcttatttctagattttaaaaacccatggtaatgaatggttctgtgattctattctttaccatttttagcacttctttctctttattttttttaaatttttcttttcactgctctcctcttttattttttcttgttccaaactatcctatattgctgttggttctccctctttaaatttttccagctcgttgttcttctctccttttacctattctgttatttccctatagtttttcccttcctggggtaattaaagctgtccttagagtgtgatattaaaacattcattaagaaaatgggagaagccaccttagttcaaaattttgccctttcccaaaaggatgcattattgtaacctaacacaaaaatttatagtccagaacccatgcttgacaatgttttttgaaatcttttatctttttctttgtgagtgattttttattttgctttcttattttgttttattttatctaaacagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 1951 - DNA, 209762 bp, Homo sapiens
cccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatatgccttcagatgaaaattctagaccatctttagagtttaggattcatttggagggaaagaaatatcatttgcaaagttgcatgtggataaaatagactcatcttttaatttaactgcatcaatagttgctatgtttttaaagttcatcattacattttacatttaaatacttctgtgaggattttaggctaattcatttcaagcaactgaatcctctatgtagacctagaatatataatgctgtaaattagtaatattacatattcttggttttgtaaacctcctccctcaaaaaactattctgttttctttgaggtgttctgattttagaaacatgttagaaggagtgaagtccaaaggaacataattgtaatatggatttacttttggtaatgttgtgatacctaattgttatcagtatggccatagtcacatttgtcacattaatcactttggcctcaatttttgcatctatacctatttatattaatttatatctatagaaatctttagaaaccaaactattaacagtcattacctatgtattgtttgaatattttcactgataattgcttttgtaatgaaaaaatacatttgtgaattgattaaaaattttattttcttacatttttaaaaagcctttattttttagagcagttttaggttcacagcaaaattgagaggaaggtacagagattttccgtagactccctgccccacacatttataaccccccattatcaactatcccccctcagagtggtacatttgtcacaattgatgaacccatactgacatatcattgtcactcaaagtccatagtttacattatggttcactcttggtgttgtatattgtatgaatgttgactgatgtatgtatagtgacctttatctgcagctttagaaacatacagaagaatttcactgccctacccatcctttgtggccttcctattcctccctccttcttacctaactcctgggaactgccgatctttttactgtttccatagttgtgcgttttatagaatgtcataatgtcatatagttggaataacatagtatatagtcttttcatactggtttctttcccttagtaatatgcatttatgtttcctccatgtcttttttttcctctttaaatttttatttttttagattcagaggttacaagtatggttttgttacatggatatgttgcgtagtatgtacatcacctgaatagtgaactttgtgtacaatactacttataagtgagaacatgtggtattggattttctgtttctgagttatttcacttagaataatggcctttagctccatccacgttgttgcaaagtacatgcttttattcttttttatggctgcatagtattccatggtgtgtgagtgtgtgtgtgtgtgtgtgtgtgtgcatgtgcatgtgtgtgaatatgccactttttttaatgcagtcattcattgagggacacttaggttgattccatgactttgctattgtgaatagtgctgtgacaaacatatgaccgcaggtgtctttttgttacaatgatttcttttcctttgagtagatacttagtagtgggattgctggattgaatgatagttctacttttagttctttgagaaatctacacattgttttccatagaggttgtacaaatttacattgccaccaacagtgaataagcatttccttttctctgcatcctcaccaacatctattattttttgactttttaataatggccattcttactggtataagatggtatctcattgtagttttaatttgcatttttctaatgattagtgatattgggcatttttttcatgttcattggctgcttgtatgtcttcttttgagaaatgtcttcatttcttttgccttctttttaatgggattatttgtttttttcttgttgagttgtttgagttccttctaaattctggatattagtcctttgttggatgcatagttctggaagagtgctggaacctctgtatcttttcgtgacttgatgtctcatttctttttagccctgaataatatttaattgtctggatgtaccacaatttacccattcacctactgatgaacatcatgtttacttctatttccttacattattacatttgccaaactcttcaaaattctcatttcatacaaatccatacaagattctcagaattcgtattctgcattagtgtctatataagccaacacaattgttgcatcatttgggtaacttactgaaaaaacaattatggagaattattttattttcaaacaaatatttaaaaataagtttggctgggtgcagtggctcatgcctgtaatcccagcactttgggagaccaaggtgggcggatcacctgaggtcaggagttcgagaccagcctggccaacatggcaaaaccccgtctctactaaaagtacaaaaattaaccgggtgtggtgggaggtgcctgtaatcccagctactcaggaggctgaggcaggagaattgcttgaacccgggaagcagaggttgcagtgagtcgagatcatgccactgcactccagcctgagcaacaagagcgaaattccatcttaaaaaaaaaaaaaaaaaaaaaaaaaaaagacaaggtttaacttttgcagatcttttggtacaggattatataattgttcttaatttttatatttaaacagtgataatttaatcagcagtgggcatttcccataagaagtctattcttttgcatcattttttgtgtaatgtgctaagggcatgtcttatatgatgatgttttgtatttggaggatcatgggaaaattcaggagatcatcaagccatcatcatgttgaagacaaattctttctaaaagtgctcagcgaaagcagtgttaatattttggtgttactctcttaaatacatattaaaatagcactttaatgtttgtttatataattgcacatccagatatttatttatcatttatactggatattatatttatcatttataatggaagctagaataatatgctttagaaaggaaaaataaaatattcagtgtttgtttccttttattaaaacataaatataaaatgtcagcttaaagagaaaacatgaagtgtgagtcttcaaaaagaaaagagatgtcagaaagtggagtaatttctacaaatgaatgcatcctcttgaatgtaacacattgtacaatggaagcacaaagttattcattagacactcactgaggacttagaaagttaaataattattgagcactacatggtttaatctcagatactttctattcatgtcttagtcaaaatgattacttttttctatgtgtctttttaatatcctaacagaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaataggtaagcattagctatgttttaaatgtattgaacaatgttttttaattctttgatacctgtatgaaatagatgtcttatggctatgattttaacatacataatcatttttatatggataataaaattaggattcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttggaaaagctaggaagagtggagtcaattgactcatccatgtagagagacctccagtatgaaaatacaggcatatcttttcctcccttaaaagcgtgatgattgggttttcacatgtatgagtgagatgtgcctccctcagaccttgttatgatgttggcacattacctgtctaatgttaaaaaaaaaaaaaaaaggctgggcacagtggcttaactgcctgcaatcctagcatttaggaggcctaggcgggcggatcacttgagctcaggagttagagaccagcctgggcaacataatgaaaccccatctctaccaaaaaaaaaaaaaaaaaaaaaaaaaaaaattaactgggcatggtggtgcatgcctctagtcccatctacttaggagactgaggtgggaagattgcttgagagatggaggctgcagtgagccatgatcacatgatcatgccactgcactccagcctgggtgacagagtgacaccccatctcaaaaaaaaaaaaaaaaaaggaaagaaaaagaaaagtgagaactgagctaggtgagttttgagctcttttgtcctatttaagtggtttgaaattaaagaaaatttgagaagcaataattgaatttaattctattactttagaaaaaaggaaactgagggccagagggactaagtgatgggcaaacgcatgccactagttaaagcttgttctttttctctcagaataggcaatggaagttgtatcagaacactggtaaatttgatttagctcttctctttcactgagttgttcagatggtttttgagatttcatgtagttgtttttttttttttttttttttttttttaaattcagatgcaaactggaacatacagtgctggctaaaaggagacttaaaattattcatctgttatgtggagtcattatttaagaatctattcaggaattataactataaggtccatcttttatatgttctgtaagtaccaaataattaatttggcatttctaatacacagtttttttaaaagagctttcatatacggaagtagattataaacctcttgcatccctacatttcctattatatgttttattttttaatatagcattctgctctgttaggtttcctcttttctcctcctgctaattgaggtagcaagacagtcaggtttagggtcacgattgtcaggtccatgagtataccaaatgttcagttcaagttcaggttctagctcacactgaggtccgaagggagtgggtggatgggcaatagctgaacgaacactctgggggccttaaacaggtgaaacgtagttttattcagcagctctctatcagcagcttactcaaactaggtctctcattagcagctctcttagcagcagctttctctcactgtctgctctgttttgactgcttgggccagctgctcctatgcacagctgcacggctggctctctcttgccttcagggtcagcagcttaactctttctctctctgggcatgaacatgaaccatgctgtgccatgttgtgccatgctgagccatgccctggctcccctcgtcagagcaagactgacagctctggtactctctctctgggtacaagagcgcctgtacaagaacatctgtagagtgtcagcagggcaattataccttttacagacaacagtggcatatggccaagggatggccttcccatgttatggctacatggctgtgataacagatggagttatatgcctgcgcactactcgctgagtcatgcaggcctggacatctgccttggcctgattcttgaccgaagcacatccatgtaccttacaaagatattgcaggtataggtgggcatgtagtctgaaagaagagtgaactcagttcaggagtgctagatatttgagtggaaaaggaaaaaaggtgcgttttatatttctttttcagatgatttttcgtattcgatctctttataaacttaaaaatatgggtggctaatatttgtgctagaaagagaacaaagatattgttttcaaatagccatatacttataactcaaacagcgaatatgtcattaagttttctaattactctagtgatgatatacaccatttttatgtcaattttaactctttaaaattctttctcattaattcttctatttgatgcttaaagtctcgcttccttcagttctgcagttattgagataataccgttgaggagcaatgtgctagaaactgtccctatacaaatgaatagagacagaaagtaaagcggggctgagaggagggggaattggggagttactgtttaatggatataaagtttcaatttgggaaaatgaaaaatgttctggagttggggagtggtgatggttgcataataacgtgaatgtatttcatgtcattgcactgtacacttaaaatggttgaaatgttaaattttatatacattttattacagtaaaaatttaaaaagaaacttaaagacatgtaaaaaaggatgaatggttacgatcactgtcctttaggtgctcaaaggctagcagttgggacctgtatgtacagagtttcagtttaagtggttaccgatatgtatttggtaggtacataatgtcatgggagcccatcattgttgtgagatcttagatgggggttatctagttaagctggtgagagaagagaggaggaaaggtttcctaaggaagtagatagctgagttgagtcattagagataaataagagctaatgagaaaatatgtgggcagtatagtgttgggaagagatcagtatcacctggaaccttgttagaaatttaaatttgcatgctaaatgacgagttaatggttgcagcacaccaacatggcacatgtatacatatgtaacaaacctgcacgttgtgcacatgtaccctaaaacttaaagtataataataataaaaaaaatttaaatttgctagctcacccctgtgaataaaaaattagggggggtggagctcattaatatatgttttgccaagtcctttgggtgattctgatggaactcaagtttgaaaattcctgctgtagaggttaatatgacagattttagagtcagactacctggctgtaccacttactaaatgcactcacaaagcacttgctatgtttaacagttgttctacctctagaaattaacacaatggaaatatttacacaatgtttaaaaattatttgttgaatgaatacatattgccaaaatgctttctaaaatattttccaatttaccctccagaaatgtcttaatgagccaaaaagttaataaaaaaataatattgtctgaaggtgtgagtagtgagtagtcaacggtcagatatagcaggaagatataataaggtctgaatgatatgtacggatttggcagtgtgaaagtaatgggtctttaggcagagctcattcgggggagcggaaggagaggttgccagaacaaagggaaacttgaagaaaggacccggaagagctgatctttatgctagttcctcattcagttgatggggggacactgcagagctggaattcatatatccaaggcatactatggctggtgctgagaatatgaaaaaaacctggttactgggaccaactgctgctgcccaggtgaggaacctttggctggagtgatatttcaagaatggtaggcaaaacaggaaggatcaactcccttgtcactccattattctagtctctttctagctcccccacaggtagaatttaacaagaatttaggtagcagaggagaactatggtttgcagagttccagccccagcatggtgaaacagagcatagggtgcatttgaagatggcagtcaatagcttaaccaccagcaaaattcacttcattggctcattggctacttagaacattcacacacacctttctacgcatacctacctttccctacaacttccttataacttcatgctttcacttaattaagtgcaactatactttaaaaaaaaaatcaaaaagatcctttatttcatgtgtatgtagtatcataattcatcaaaataatttataatagttaactgcccctcaaatattgttttataaatgatgccttctgaagttaaacataatgtagattcattttttaaaaattgtctgtttagaacatactaaacaaatgataagttaaaaaaaaatataattctctcctgtgaagtcttctaagaaaatcatggcaagttcctgataagataaaaaccattccatcattaaaggggattaaaaagaggcataaataaatttgaataggaacatctgtttgctgagttttgtcattgtgtacaaatgaaactctagagttaaaattatattctgatttccttctataagcaagaaattccttaatagaagctcagaaatgacctcagtgccttggtgaaacatacttcttcatctgcggacactcagtgctcccatctctatcagatctgctgtgttacctctgttaacattcccaggcatctccaggaagacgggagatgtcatcctctccaagatggctctaccaaaccaaggctttcctggcaccaacaacgttctttctaaagccctacacttcacagaggaggcaaagcccgacgaagcaccatttctgccacggtgtccaccttaagcttccaactgccactgttgtgaggaggagccatcacagattgccatagccacagagtcttcctgaccctgtggagccactgctctcaggcactgtccagctgacgtctggtgtagccaattattttccccaaaggtccatgtctgcctgacccatggcactccacgagttgtggtgggtctgatgagctagtttctgtcatacctagacaaagaagatggtttaaaaccaattcatgctcttcattataaatccagatctgatttgggtccccatgctcacaagtcttaagcactagtaggcctcctttccaacttgggcagccctgagccaccagacatttgttggtctggaggtgatagagccttccaagttgaaggactttggggcattttggccctctactgataaaagtgggttgctgggatttgtcatgggtcccagatatctgcatctttgggtaaatattacccaaataccattcaaatgatttgcatcctaacttctttctcaattcaacatgctcactgatggttccaaagcttttcctctccagattaagtcttaaggaaaaatactgcgcctttattcatccagccagacatgtgccagctgcaaaaagttgtgttcatggcatcccggccttcaggagatccatatggtcccctttttttggaaaatgtgtcctactgtagagcaaggcatgatgaagaacttacctccacacacccagatctgaaatgttatttccaagttttctcctctccagatatccatgccagtatcatactgtccaagttcctggaaatactgtctgttcctggcaaacaatcctccagccattatcggtgactttgttggtgctgtggctttttctgctcatcctagctcagaaaggggaacaagctcctatttgaagtgcagccctcagttgaatcctccacggacaacagaggatgagctgtaggctagcgtgttggcactaatgatatcaatcactgagaacatcatggtctgctagtccacacagatgacagccagcaagggctgctgccacatcacattcacttcaattggctgtctaggaacacaaggacttctgttgtgtggactgctacactcattcttccttgaatcaatccctcacactttatgtttcttataccttaatttttccaaggaggtatttttggacatattcatctcgtcctcctttcaagtcatcaaggtcgctaacaacatccataaagatgatttcatgaagcaggtttgctggcatgcaatttgtgacaatgtgcagcatctggagacagggcagaaaaagcttcattgtggaaacagataacaattatgtaagcaactggcaggtcaggaggtaggactttacatgctgtattctttgtccctggcacatctctgtggtagcctgcagttactgataagcatattaaaagcacatttctgatagcccgtctctcaactcctgagcacgttaattaaaaatcatgcctagttcagaagacaatttcaagtggcctttttctggatcttcaatatgaccatcacatcatcaattttgtttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaaggaaaagattgagaagaaattagttaatatatagaaacacacacacacacaagcatactgtaagggaggaaatatgcacagctgccactgctcttctttctgtattgattaccaggctgtagttaatatttattactagtgttagaccactggactaattctttaagtcacccagaggaggaacccagatatagtgccactgccatcatatctggacattgaatgtccctgtggtcatcatttccacatggaggtcacctgatgccacgactgatgaacctacaagcccctgcatctttgtgcaatcgtcatgagggctagtgtctcagatgtagttatctagttggtgagaaggtgctctagctgccagtgtttcagccttgtatgatggtagattcttcagtcagatattgggcaaccagcaagtagacaaatgtccttaacaaaagtgactgagttataaatctctagaggcctgagaagcctggctggggttggaaagtggaggtggaagactaatggataatgaatgtcccagggtggataattaaaggatgaaatcatgagtttgtttctagtctatagaaagtgacccagcagggagagaaaagttgataatcgaaggggagccattgaagatattttattgagagtgaataatggaataggccaattccatgaaaagagcacagggttggtcttaaagaaggtttacctcaacttctgagtattgagagaagaaaggaagccctatggtggatgaagatatatttgaagctcagggcagtttcctgctttattgagcaaaataggctttagctcagagaaaagtattcctttgcatagtagtaccttcttgcaatgacctaaatgctttggatgtgattaaaaattctcacttgggtgcctactctagacaatttctgatcttatcagcaggttaaggcaaaatgctcagttttaaagccccgtgaatatgtgtaaggtcttaaattctattatgtatatattataattatgatgaggtatttttctgaaaaagataagtatatgtgtaatatatagatatatataatttcagagcattataaatttgaatagttacttagttatagctgagaattttagcttcagtttagtcagccaaacagtcattggtctattcttctaaacaataggacccagaagaatgagaaaattaggtaaattaggtagattttcaaactttcttacaagatgatttttaatttggtcttcttttacttggaacctaggtttctaaaaatattagcacagtaaaacctgtcataatttcaaggaatttgagaaacagtctcccatttttttcctgccacattatatacctctatgatttggttaatatgttcattgcaccaactatcacatgctgtttctgcctttaattgtatttttgtttggctcttaaggcaatgtatctccaaacaattaaataggactctaattcaatgggtagagctggtcaatataggaagagctggtcaatataaccaatgagaactccatggaagagaaaatccataatggtgattactatagaaaagctttgaatcagactcacctattttggacatcagagaattcacaagagaaattttcaaatgcttccatgtgtaaaaaagtatattttaaaagggataaaatctaatgtttgtaagggatttaaaaccatataaatatgtcccttaagggaaagctttgtttgggctcagatattaatgtttgtcagagagtctgaaggacagatactctagaaatgtaatattttgaaactgctctgagattttctcttagatctaggaaggaaattctctttctttattaggtgcctactgtgtgttccaggcacggagctgagcatggggaacaaggttctacaacacagactcagcccttgccctcctggagctaacattctgtggtaaaaacagaagacataacagcaaagtttggaaaggctgtgctgtaataaatacagtgccttgtggaaacaagtactagggatatccagcccaggtgaagagggggcagaggagaatgagccagagagtgaagaacatttgcaaaggcccagaggcacagataccacatggcaggacttgaaaagttgagtgtggtgggactgggaagctggggaatgaagagaaatcaggatggagggatacacaagggtcagattatgaagggccctccaggtcatgcttggagtttgggcttctataactactaacacctactttactttgttttcacaattactcctgccagcattcttgatgatttcagcatccatgtgattaatcttcagtttcttgaatgcttattttcaatattcttgtattttcacaccactttgttcaccccttgtcatggacatgctcgagactttgtcatcaccaataagcatgctttttctataatctccatgtcaagaatcctgctctttgaccatctccccttgcacccttcatgttagtttattccctctactactcaacttcaggaataattctccatggttcttggctcccccttctgggtgccaggttctggcctgagtaaccctctcttcttcatgaaaagcagcccatatgcgcatctaagttgttttcacagcctgctttcctaccagcacaatttttaatggttgaaaggctttttttttttttccattttgttctgtctctgtctctttctgtctctatattagcactatttctgctaatacacttctctcacaaaactacctggacctccagtggatctctctggtgttcactccattagatatgataaaagcctgcaaatctcctagagatcttttctctgtcttctctttgatctttgctcagaaggcatttcttaattttaacagtgtttgctatctggagaggctagacacttcaagactatgaagtcctctttccttttgtttaagggccctttcttcaatgtatatctctcctcttacagcaagaagaaaccaagagacatccgcaacacttgctggaaatctccttaaatatatcattcagttcaataggcacattctatactttccacataactacagatggtaatgttaatgagctctctgctactacacaagaaggaccactgttctccagtttccaataaattatctctcacttccttttgtgccctcactggcagagtctttgaagtccgccagatttctactaacagcctgttcgaggcaatttaggttttcttcaccatgcttctccaaatccttctagcctctgtctgtccgctggttccaaagccactcacacattttcaggttttcattatggcagcaccccactttcaagttccagtatctgcattagtgatctaatgtcatataataaattaacccaaaacttagtggcttaaaacagtaatcatttattatctcacaatttctgtttttaaggaattcagctgcagcttagtgtggggtggaatgggaaaggagtatctgcttcagggtctcttacaaatactgcactgaaggtgtcagccaccaggactgcagtcatttcaaggttcaacttcaggaggagctagttttgagataaattcttggggttccaagttcttcatgggatgttggactgagggcctcagttcctccctggctatcggctggagacctccttcagttccttgttatgtggatctccccataggacagcctgcaccattgcagctggctttcctgagagtgagccagagagactcactgatgatcttgctttttattttcactgagacaacagaagcaggtggagtttctctaatgattgcttttctcacccaaatctaccaggctgcctgtatcagtgcccatgcacttttcctctcttcttttattgtgaataaattctttgagttctgatctaaggcaaaccctttgttacgtgttctgagtcccatctcttattgtcaactcaaggactttcttgccattatcctctattttctgcaccatcatgtttctctctcagctaatagacacgatataataactcccatttaaaaaaataaattttctctgttacacatttctgtcaagtaaccaccccatttcactacttcttttaaagaaaacaaagttttgaattgtatgaatacattatatcttcaaaagttaataaaaaagtcaacaagtgactctggccacgagggaataagagggtctggattactctcctgtgataaacaactagaaaactggaaaaaatgtaggaaataattattttcagacattggacaaagacagacagaactgtgattcctaagagaaggaaacaaaatgagtactcctagtacttaggctttctgaactgtagaaaattcccagaacatggcacagagctgaggaactcaagctgagcccaacaatcttgcagagataagagttcagagagggtaaggggctcaagttcatggggcagagtactttgaaagcaggagcatacagaaaaacttacagtggggccactttaactctttggctgaatatcaatctggccacaatgttgggtaagaaaaacttctagtaagagaacagttatcagggagctataagctaaacaattcacagaattcatagaggtctgggaatcgttcaagttcccacaaacgagattggagagaccttaatgggtatcagtgacatttcataggaactccagaagagctatactttaaaggtggggccaaattagccttagagtcaaggctacactatactattccccaaaatgcttaaaggatgccctaaaagattcaaattagtgctcaagtaacttaactgactttcagaacaaaatccaacactcttcaaggcaaaataaaacaatgtaatattcaaaaatgaaataatcacagtgtctggcagccagtaaacacatgctagatatatgaaaagataggaaaatgtgacccataaccaagagaaaaagaaaaaatagtcaatagaaacagacccggaaatgacagagatgatagaattggtagacaaagacagctatcattaatatgctctacatgttcaagaatgtaaaggaaaatatgaatataatgagacaggaaattgaagatgtaaaaaagaacccagtgacatttttaaagatgcaaaatgcattttttgtaaacaaaaatgctaaatattaatttgggcatttagaataatgttattcaataaaatagtatttatggtgtgcagcccatagtgctaggctctgtaaggggtgcacttttcattctccttcccttctttcctttctatcaggatggactcatggattcttattttagtttgtgggctacaaaagttacatcatttattttattactgaaatcgtctttctttctagcagtataagatgtaccaggttgatcttatacttttcctgatataacactggaattagccatttctccaaggagccatcgttccttttgttgaagaatggtatttacaaaccagtgtctggaggatagttgttcgttgttattgtttctagccctctctgtgtgcagagctagttagtgcacacaatatatacacaatgtgtgtacataatatacacaaatctatatatctatatatctctgtatgtacatgtattaaagggtgtgtgttcatactaatatgtcccattctaggccaaaactgcacagtccgttctaaacttcttttctttctgttttgtaactttcttctccagcagtgagaaagaaacctggcttccctttcccacagtgtgttacttatttgctcagtgctagaatacacacaaagcagttttagcattgctatcccatactgctgtgaaaaatgaaaacaagcgtactaactgaagtgcaatattgtttacactcattttgcctttactaaggctaatgggtacatggtcaaatattatgttccaaagttaaataggataggtcttccctctcccttcaggtggttatattattaacttggtagacattaagttctgtttgtttcagtttgcattcttctttttttcccactttctcttctctttgttgattttccatttatttggtgatatcttacatctgaagagtactttgcattttacaaaatgcttcttaaactttcctccttgataagatttatctaggtcagcactacttacttggcattcaataggtctgggtggaactagattgcttgcatttattcagaacatagattgcttagctctggaccttctgaattcctcatggggtctaggaatctattttttcacaagttctccaggtgatttttatgatgagtctagtctgggacaataactcagtctcaaattattttggattggcaagagaaaattttgaggtaatgtttttatagattaccaatctgaaatttaaaataagtgacttgattaaatgatttacaaaactaatactaaattttctaattccacttcattggtttgttcactattttgctgtcagtttacattacaatcagaaaattaggtggcaccaatttggtgttattcctgtaataatttagcatagaatttgcttggagaagctttaatatattcacattttctgggaagaaaaattggaccaaaagtcagaggacagaatgtgctttctttctaaaccatgtatggctaccaaaaatgaaattccaatactaaagaattatatctctaccttttgtgtaaaaatattaccaaaaaggcaaaaatggtaaagagacaaaattttaagttcatttgacaactgttttcatactattttcactttcaagtaaagtttatttacatgtagaggtattaaataaatagtggcactgagtttgtatatgtgtatgtatactggtaaggcataaaatattttgttgcatataaaattttcaagaattccagaaattcttaatgtttgcttgttttaagccaagtatatctcctgttacttttaaaatttgatgatccttttattctcatactttaaaattatcaaatttgttagagtatgttttgatattagtaaaaacagagttcttaacttcttatactgactttggcatgtaacaaggttggtggattccaggtttcacacaaacttgggaaactcctctcacaaatacaggaaatagctaatgtttttccttaaagaaaagaatcatttgaagtaattatataattctctaattttccatttataaaaatattgacatgattcaggttataattattttttagtcatggttactatggtctttattgatctctaaataaaatggtgatgataacagtgaaatttatcttgtgacaataaggcacgttgggtgtaatgaaatgaatattgaacatgatgcacaagacttcagttgagttccaggtctaccttctctccaaatctcagttttcttacctgtaaagtagatgatgttagttccctcaaagggtgctttgaaaaactggattagataatattactaaaggtgtttcatgtaaattgtaataatgaaatttgatgatatatttaatgtgctttctctatttttgtgtcctttgcccatcaaatacccaccagtagggagtacaaaatacttttggcttatacctggggagggagaattttcttttttcttaaagggccaaatagtaaacattttggggtttgtggaccatcctgtcttggtcacagctattcaactctgtgcttgcagaaaaacaattatagttagtatgtaaattgaattaatgttactacatttatgggcactgaaatttgaatttcatgtatcatgaaacagtcttttttttttttaattgaaaatgtaagtaaccattcttagctcacaggctgtacaaaaacaggcagatggctggatttggcctgtgggccagagtttgctgatcccaagcttagaacattttgaaattagttttagattgatgctgatagtgtcatgatggggttagctgttggcatggttacagaaagcttttttaaaaaccaacaaacaatgaattactataatgcatattttataatgtagatactatatagtcattattaaggatatatactctatatgatgttttgcatgtgtattacaattattaacaaaatgaaaaagagattgaataaatagaaaatacatcagtgaagggatgaggaaaccatagagttaatctgattttaaattcgcccttttttacaaatattcagtgtatttagaaaaggatggctttggcaagaccatctaaagtaagatgatgtgattctaacttttctttttgtcttaaaatatgactaaaattttctatcatttaaaatgttagcagagaatatatttgttgttttgtgctcaacttaggcaaatattcttgctttaaaattctgaagtttttcagccaaagcataataccttgcaagaatgtttccgacataaaacaccacaatttattcaatttgttcacagactttttgtaaaagcttttattttaatatttgaaaaacacctaaaaggtctggcttgatatttttaaaaattacattttgtttgctttgcttaaagatttagataaaatcgaaagtgctaaatcaggctacctctaattcaaaacaatattttatgggtggatagcattttacagttctcaaaaatacttttatgtgattattgtctttgatattcacacccttgtaaacatagatggttcggggattgtcttggttttattgattcaggaacctgaggctcacaaatataaacttacttgtccatgatcctatggctaataagcaaacagaagtacttgattttagatctcaatgttaatttagtgtgcttttgacactaatatcccctatacagttcccagtagattccttggcacattaaagccatgcaaatgttgtttcagggttgattttttttagtagtaaagtaataataaattctattacttgaaaatatatcataattcaaaacatttcatattagtggggtatgcagagaaagactagggtctatttttcatgttttttatatctggatgctcatatatatgctagtttattatagcttctaaagcaacacttttccatactgatttttaaattattacatttgttaattacagtgttttccctctacaaggactgcaagatttctgaaggcagtgatcatgcactatctccctatccccaggttctttgaaaaacagtgtggtttcgatatgaggtagcagatattaatggatagaatggggcagcacaggtgagatgggtagacagagacactgttactccacactcttctccccactgctcttattctatagtcacttcatttacaccaagacttagactccctaaaggatgaggcagatttataaaaaatctagtaagtaagaaataacaactgtctgttcttggttgcatgctattattttttatgccctgtatttggtaaccctacccagctaattataattttttttttaagattgacctacttatttgaaggtttaaaatgataggcaaggtattgcttacaaaaatttcctggattttctttctttttgtaaatagttttattgaggtatagttgatatataataagctgtacatatttaaattataaatttgacaaatattgatctgagaaatcactcataaaaccatcagtataataaagaaagtgaatatatcatcaattagaaaatttcttcctgctcctttgtaatcccaccctcatgctcctaccattggtacttcctcctcccaccccacctctgtccccagggaatggctgatctgatttctagcacatagcctactattactctagcattttttagaactttatataaatgcaatcatacagtactttgttgtgctttcatatacatgattatcttgagattcattaatgttgtttatatcagtatttcattcgttttgattgctgaatagcattccactaaatggttatattgcaatttgttcatccattcacctgttgataggcatttaaattgtttatagtttttgactgttacaaatgaagttgtcacaagtgttagaattgaaatatgttttcatgtctcttggataaatgcctgggcatggaatgggtacatcatgtggtaggtgtgtgtttaacaacttaagaaagtgccaaactgttttccaaaattgtatcattttacattcccatcagcagtgtaagagttccagttcctccacatcttcaccaatacttggtgtagtcagtctttttttaaaattttaaccattctagtatgtggatagtgatatctcattgtgattttagtttgtgtttcttgagtgactaatgatgttgagcatcctttcatatgcttatttgccataactatgatttatatggtgaagtgactgtgtaacattttgcctatctttttaactgggttgtttgtattattattatttagttttgagtattgtagataccttatgtatacaaatcttttatcagatagataattggcaaatatgttctctgtgtatggtttgtctttttgttatctttcatagtgcttctcagaaaacaacttttcaattttgataaagtctaatttatcagtttgttcttttatggatcatgctttttgtgtcatatataagaaatttttaattaacacaaggtcacaaaattttttacttatgttttcttctagaagtttcatagctttaggttttacatttagatttatgattcatttggaattaatttttgtatctgatgtgaggtatggattaaagttcttttcttttattgcatatagatattccattgttccagcacaatttatcagaaagattatcatttttccacagaatttcttttgtgcctttgtagaaaatcagttgtccatgtaagtgttagtctattctagactctattctggtccattcatttacttttttttgtttttacatgaatacttcattggcctgattattgcagctttataatacattttgaagttaggtattgttattcttcaaaatatgttcttcagtttcaaagttgttttggctattctagattctttgcatttccatatgaatttttagattcatcttgtcaatttgtgtaaaatagcctgttgagattgtgagtagcattgcattaaatctgtagataaatttgaggagagctggcatattaaccatattgagtcttctgacccataagcacagtacatctctcattttagttaggtcttaataatttccgtcaacagcatttcatagttttcaatgtgcagatcctaaacatcttttgtcaaatacattacaaagtatttctatttttgatgttattgtaaatgatattttaaaataatttctgtttcatcagttatccaatataaattcagtatcataaaattattcatatttccttattatccttttaatatctgtagactgtgtagcaatatcgtgctttcagtttttatattcttaatttgtgacttctgtggtttttcctggtcagtctgtgatatggtttggccatgttcccacctaaatctcatcttgtagttcccataatccccaagtgtcatgggaggaacccagtgggaggtaatcatgggggtggttacctccatgctgttcttcactattatggcggttacctccatgataatgagtgagttctcatgagagctgatggttttataaggggcttttccccacattcactctgtacttcttgctgccaccatgtttgcatgtccttccaccatgattctaagtttcctgaggcctcctcagccctgaggaactgtgaatcaattaaacctcttccctttataaattacccagtcttgggtatttcttcctagcagcataagaatggactaatacagtctggttaaagcttctttcatgttttaaaatcttttaaccagcttttggctttcttgatctttgtgtattatttttctgtattctatttcattatattctgatttgatatttatgatttctcatctgttttaaagtttggttgaatttgctcttttttttttttcctagtttgttaagacggaagctgaggtcattgatctgagacttttctttttttctcatataggcagttagtgcctatatttagtgttaaacacatttccctggaattattgctgtaagcaatatcctaccttaaagaatatgttgtattttaattttcatgtacttaaaaaatccttctaattttttttgatatgttttttgacccaggaattatttagttgtgttcagtttccaactatttagggcctttccaaatatctttctgttattgatttctgttattaatcctatttttgtgtgactggaatcctttaaaatttattgagacttgttttatggaccagaatatggtcttccttggtaaatgcttttgcaaagaatgtgcattctgctattgttgcatggagtgttcttgaaatgtctattaggtcaagtcagttgatgcgttgttcacgtttttatccttactaatttctgtctatttgttatatcaatggagaagaatgttacatcaatgatgaaatgaaattaatcaataattgtggattagtctatttctccttaaggttctctcaatcttttgcttcatgtattttgaaactctgttattgggttcataaatgttttggattgttatgttctcttggtaaattgatccctttttcattatgaaatgatcatctttatcccatggaatattcactgctttgaaatctactttctctgatgttaatataaccattacaactttcttttgactaatcttataatggtatatcttttcccgttcatttccttttatttgtgtttatagttaaaattgatttcttgtaggttgtttataattgggtctttttaatccagcatgataatctttgccttctaaatgggatgttaaggctgtttgcatttagtgtgaaaattgatatgtttaggtttaaatctttttatttcttttcttatcctattttattatttgtttccctttcctctttttatgccttctttttgattttttaaatgattctacttaatatcctttgttgcttattaattatattttcttgttttattattttagtggttgctttagcatttataatatttgtcttcaatttattatagtccaagagatagtatacctctaagtgatatcataccacttcgtgtaagaacattacaaatttctcccctcccaagcttggtactaatgccatacattttacttttacctacgttgtaaactccacaccacggatctattatttttgctttaaacaatcaataaatatttatcattttagttaaatttaatttctttgtgtgaaaccacatttctatctgctgtcatttttttttttttttttttgcctgatggattgcctttagcattttttatagtgcaagtctgatggtgacgaattatttttgctttggtatgtctgaaaaaaaaagcctttatttcatcattattttgaaagctgttttcgctgggtataggattttagaattgcagtttttcttttattttagtacttcacttttacgtcattatctttttgcttatgttattcctgatgattaacctgctgtaatctttatctttgtttttctaatgtagggtttttttttttcagataccctttaagctgggtgtcccaaatagtttacttcaattagtatttagtatcctgctttaaaagcctatccagtattttcatatctgttttaatatttagctcttatttttcaatataggcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatgggtaagttatgcactaaaatgatgataataggtctaaacatcagtcatatataaaggttaaaaattgcttacaaaaatatttgctagcttatctcactttgcttaacactgtaatgatggtagatgtagtactgggggtattaagagtggcttctagaatgatttaacaatggtatgtatatctctgccattgtcacttaaattctgttttgaaaactgttttctttcaatcctggatctatgtaatggatgtatattgattggatatcactttttcacatctcagataactatttttgaaaatagtagcatgtttcttgcctgaatttattccttcaataaatatttcttagaggctcatgtttgtcagagactgctccaggagctggaaaaagagtgggacattagacatagttcccacctcagagagcagggacaaacaatagtaggcagagacaatgataaaagagtaaatgagtaatttactgtacaaacatgattacaaaaaacttcaaataatagacaacactctgttttctttgtgcaaagatcccccaaatctctttttatcaatttaaatatacaattacaaatgtgaataatacaggaaaatgttagcgctatgtatttaatttattaatttcatttaattatgtataatttagcagtttttctccacttatatttcctgaaacaattatatgcaaactctttatgtctgattttgcatcattggttttgacatcactagagctgcttttccaagtatctgatacaattttccatacaactcaagctttacttctttctaagttactcgagatatagcactttttgaaactgtgtatgacatcatattttaacatgaagactttcaaataatttgtcctgtagggatatagttgtgatctccacaacataattacaatggcatacaagcaattcaatcgtgaagttataccatagagaaaaaagttacaaaatctttattcaatatcattttcttttctttgaaaactaattctacctgatgattttttagtagcatttagagtcaacattgagtgcattgtttttcaaaatgaagtaggtaagggaaagtgctgtggaattttaaagaacttgaaagctttcttaattttgtctttatgcagagataattttggggaaaagtatttccttctatttgaatatatattataatatccccaaattatatgttccatgaaaaaaataaaactggtgtgatggagtgtcagggactattatttctactatgtagatcaaagaagatctcctttaggacatagcatttgagctgaatgaagaagagatatccatgcaaaaatccagagcaaaaggtgctccaagcaggaagaacaatattcacaaaatccctaagatacaatgaacttggtaatttgaggaacaaaacagaagacctttgtgctaggagtgaaagagatatgagagtattaagggatgaggtcagagttacctggtccagagcatattgtaggccagggtggagaagtaaagaactgttttggtttggatctgtttgtgagatggtgctgactggactgtctagtggatggagttgtagagtgtgaaggacagaggggtatcaaggataacctttaaatttagacctgagcatctaggtgaacagagacaccagatactgagatacggaaactcagggaagattaggtgtgtgtacagaaatcaagagctctattttggacacattgtatttgagatgtctattggaaacctaagagacgttgaataagaggttggacatatgagtctaaagtttaggggagatatatatatttgggagttgttagcgtatcaaggtttatagtattgtatgagatcacctatttagagttcaggaagagaaagactgaggggttatcagtaagaatgaaggagtaaaagagtatgttgttgtagaagccaagtgaaaaaaatatttcaagaaggagggaataagcatctatggagtgctgctgaaaggccgagtaaggtgaacaggaaattgacattgggtttatttttgtatttctaatattaatgcatattaatattgtcaacctaaaatgtatgacagataccaactctataaagcaaaaagttgatttgggagtagtaggggattgcagttctagacatgcatgctatggaatgactatgacacatccacaggggattggagtaaaggggaagcttgaaaagacatataggagacctccatgtaagctgttttgaacaaagattattggttacaagagcttgctgcaggggtggcattagctcattggtggagacagccgtagttaggcaagtgtctctgtgcaagcggcttttatggaatactgtggttttgaggaattctttacgttgttccaatgtaggcatacatatacataaggggactccttcatggcctcccaactccattgtgttagggtttcacactagtaactccagtttgatactgataacttttacagtatgcagataggaaatgtacaatagcttgtaatattgtaattttacttttctttggtatatattgttttctctttggtcatggaaacacagtaaatttcacctgctgtttccagacttttgtgtttagctgtctctgctttaaagtaactgaaatttataatacgtctcataaagtaaaacctcattgattttgactaaaagaggaaaattgtgaccaaattcttgaaaatatagaatgtgaaaattatcttatgctctttatttattgaaaataaaattcaaatcagtgtttcaatttaatgataatttctatatatatgaataattcctgttaattgtaaaaaccttgctaatatagagatgaacaaacaagaaaatgcatcgattttctatcactttggcgatctttatattttaactatatcaggaatccaagtataaatgtgtgttaaactttcaaaatttaaacattaaacatttttaatattctgagaaacttcatccctacttctgatgacaagccagggactgctgatgctgcatttattgcatgggaatatttatgctgtcagttatttgagtaggtttgtctagattatagtgatctaaaattaatagacaagctgaattttgggtagttttgtgtatttccaaatagtgttctgcaaaatgcttttttcctttttaaccactaaaataattgaagtgggtgaggttcaggggagacttcagataagttttaggatgctgggtttaataaagttaagtgggattcttacaaggggaaatcacatttagcaaaataatctcatttactgattcatagtctttaccacttaaggggagggtaatgaatatacatggattgctatgataaggtacaaggacgagacccagtattcaagcttgtttcggttctataattagtccttggataaagtcaccttttaagtacttgaaaggcaagatatgatgaaaatttatcttgactttattttattcagctataattgtcatgaaaattacttgacttaaaagtattctcttttttttccttaagtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagtaagtatattttagtaagtaaaaggaaaagttgagaagtaaataaagaccctcttaagtcccatagcaattaccctctgcatactaaatatatacatttcttctaaagcagaatgaattataattcaacatttcatattatatatcatatatagatagatatacgtatgtatatatatggctataggaaatctagttacagaaacttgaattcataattacaattattttccaccaacagaccactgatttcatcttttttttaattgctcaatctatttgaatgtttttctgaatgtggcaacagaaagatttttgcttggctaatcattagtcgagcttctgaatcttctgctagcccgatctgtgcacattcctgtaaaatccagttttagcaaagaactctgctaggtcattttagcaggaacacccccaccctggatatctgatgaatatttgatcagatttctcatcctccaccattccccaaatgatgtttgatcaccatggcctgtcttcagcaagaattctgttaggtcagtttagccagaatccctcttaccatgatgtttttgcttagtaattttctatctactccctccttcttggctataaattccctgttgtccatgctgtgtttggacttagcccacataccccgacccaccacaagaccccattgcagtgctccatatacctattgtgatgattccaaataaagtcttccttacttcctttctctttttctttaacagttcgttccgtaagtatttattgaacacctgctacatgcctggaactgttctgcttgcatcaggatacactgagatagcaggacaggataagaggaatctgggggtgctggtagggaatggaaggttgcaataataaatggaggttggggagggtgacatttgagcaaggatgtgaaggagatggtaatgtagatatctgggtagttgggttctaaacagggagaacagcagtgcaaaggatggtgtggctgagggcagtgaaggtgacagcagtagtggttgaattcagaggccagcaggggaagagaatgtggagctcaatgaaaggcctcttgggccatgtgaatactttggcactttactttgtgaaactaagtttcatataatttagaagtaaaaatcagtctttttagaactggcaaaaaaatttaaaacattttattttcacaaagagaatgatgggaatcctcagtgtcacatatggagaaaacagagttaaggcttctgtgggtttcagctttcttatctgtaaactggagataatttgtgaacttgaggattttaaataggagttattaatatctgatgttgttttatgcattcctgatgcttttcataatttttagtctgtgacatgctccccttaccccaagagcagtcattagagccagagaatttattaactttggagtacatttttgggaagctgaattttgatctcctaggctcaagtgatcctcctgcctcttttttttttttttttttttaagagatgaggtatcactatgttgctcaggctggtcttgaactcctgggctcaagtggtctacccacttcggtctcccaaagtgttgggattacaggcatgagccaccatgcctgaccaggctcaggttcttaagacttttcatgctcttctgtacagggacacttgtagttctttgtctacccctgcacagcattttctaccaggtgtgtgttataggtgtcagtagtggcttaaagcttcccacagattttagctgcatttcttaaaattctaaaggtcatatattcatcatgattcaattaacagtatttgttaattatcattatgattttttcttggacccatgggctatttaaaattttattgactaatgtgcaaactttttttttggttattgatgtttgttttaattccgctgtggccagataactactgtgtaagatattaattctttgaaatttgatgagattagcttatcctcacttttagtaaaggttccacatcaacttgatgttctgatgttttaatataatatttaacaggctgacaagattgtctcagctacatccctgctagtagacagtatacttcctgggtcttcgtatgaggttcaggtgaggggcaagagactggatggcccaggaatctggagtgactggagtactcctcgtgtctttaccacacaaggtaggttatgtaatagccacttctactgggagggaaatatatttcctgaacttgcctttgtatagtataagcatcttacattttgaggccttaaaatgaaaggaggaacacagtatcaacttccttgtttaaactttgaacaggccaatttgtgaattaaaattctgtcagagcctctaggcttgtgtgtttctattgcagtatattgtaggatcacttttcctattaaaaagaaaaaattaatataacagctccaaattaacaaactcagaaagccatttgtattgataattccttaatttacattttaaaaccaagcatatttatttgacataaaattcaaatattaacattttactttatattatataataaatgaattatttttactccagatgcttgcttttgagagttttcagtgccaatgttcatattttaaaggttatttttagcatcggaacatctacagttcattcacagcttcttcatgcagctgatgcgcaaagttttgcatagaggctccagaggcttggaatggtcctagacctgttgcatgcaaagttgggactatagaaagacaatagtcctttggctggttgtccgatctgtcaaaagggcaaaatttttcttgttcagacttactgagattgattatggcctgtacagagataacaggtaccatgcaaatatcaatccatttaacaagtttacttgttgattgcttactattttaaaagcattgattcgtcaaaaggcaagtagcaatagtagtttaagacattgacttcggagtccaacagaagtttataggagttctggctccaccacttatttggaaagtttcttaacctttctatgccttaatttccttatctgtaaaatagggatgttttacatggatatgaaatatccatataaaattaaataatgaaatgaaataattaacattggtcatgtgaagaaaaccattattgttttcttattctgcaaattaaaaattgcatagtatgtcatatgcagataaaatgtgtatctatattattaaaattttgcaaattaaatattcaatatctcatatcaatttcaataaatttatccagtgtaaatttcacaaattgtcaggtttttattaacttagttttcttattttaagctaatattttagcatctaatcatgtaaaaatactatgactttaatcttatttctcagttaagccttactatatgtatttgatttcaaagtgaaatgctttgaattttcttgtcatctttaaaatgaaaaacttcagcttaatccatgaaaactcaattatattttttatttttaaataagaattattctgagacttttgaggcagttgagtaaggaggttgtggcgcatactgaaggtaggttaagataggttaatgtactaggtacttgtccacagtaagtaatgtacaagtgaagcttgagtgccacctcggctaggattatactcagtcacgctcataaatctaatggtctggctcctgtgcagtaattttatgctactaagttttttcctgtttctatttgattatggacatacaaaacacaaatgttttgtatgaattgtaaatatatagacattgacgtttaccatgctattacagaataaagaaaacttaataaaaaccaattaaagtatttttgtttctgtttttaagggtaatcccaagatatgtgtgaaaacaaattttcatagtctatcaacagaaaatggtttaccttaactttacaactgaaatgtactgacgtttttgcagtgcactgtggtggaaataatttcttcctatgtaaaccatcatttacttgtatctcgcatgtctttgaaaatgataggcaaatgaaatttacaacaacagaggactttaaaaatagtatagaatcatgtgtaggcattaaaaaaatcatgttttaggaaaatatcgcttccctttaccctcatccataggatattggcattaaataactcaaaatgatagtacaaaccagtatttcccattttctctgctttgtatattgctgcattatcattcatacgacattcctattttttaatttatatctcgtatctttacctacttacttgaaatttttatgtatccaaacaagacaatagcggcaatcatttttacttcaggatttggcttcatagtgatttgctttaagaacttgtcctagtttcactgattcccaaagcagggtctgttggaaaatatgtcattgttgaattaagctatattttgttttagtcactttcctgcctatcagttagcaagtgacaattactggctaaaacatattttatgatgaataagcctctgtgtttagaagatagtaaagacattcatggaagctcaactcactttagaatgagagcactcgggacactagataactgtacacaaacaggtaatttcagcattatccagtttttaaattacactcattttatttttggcagtgtaactctggaatgtgttgtgaatatttttcgatgtggtacaaattacttacagaatgttttgtcttcatctgatatcctttcttccctcattacagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattggtaagaaaacagaggttttgttcattttgttccacaacttgaattttcattatggaccctccttatattagagtcctgttaaagatgtaagaaaaaatttttttcattgaattttttggagtttttgctttatattaatattttaatatgtttcaaatagatgtcaatatcaatatctcatgtgaaactgatgggtacttaactaaaatgacttgcagatggtcaaccagtacaatccagtcacttgcggaaagcactttgcaattgaggtatcataggtacgtattatttttgctgttttgtttttctgtgggcacagtgagataaaaattttctttagaaatattacaacagtagtcttacagattatttgcttcctgaaagaggaaagtataatataatgaatcaggaaatttttgagggattatataaattggtgattcttgaaaaatattcacacctgagattaaaaaattgtaatttgtttttacttcaaattatcttttctgaaaatcaatcaattctgaaaaatttgtattttaactcttgaatgaaatgcaagaaaatgtagtttatatatattttaatttgacttagttgactagaggagaatgtgaaagattataaaagtttcgtatcatttggctaaagattaatgttttggaaaaaagaggtaaaaacagattataagagataatatgaatggtttttagaactgagtgagattacttaggaaataaatacttatggttaataaagggtaatgtgttctaatgagaagtaatttgtgcttgtttatttttactcttctatgttttaaaaagaattcaaggcatcgtcttatagtggtccctttctttctaaaatcattttatctaaaatgatacaacccttgattatataatagatttttatttttaaaaatatcccatagtagtagtcaagtaaatatatactgctgttaaacactgtgtcccaatttatatttttatttgtagtggagactttcaatttgtataacatgctcatttattcttaaaatataaattttcaactagaaaaataaatcccttctctcaaatactgtgatctgaagtctattcctaatgctgccagtctcttcttatgtagcgttaggaaaaaaatgtggcaattcgtacatttctcaaatagctgccttcatcctacctaatatgagtattttaaaatcagtagaattgttcatgatatgaaattttacttttataatctgtctttacattcttttcatggcattttcacattagaaaaggtgtttatggaaaactattatgttaagccccatgccttgtttctcttattaacatttacagaataactatgaaactacatttacttgggtgagtttcttaacttccctaagcctcaatttccttgtctgtaaaacagagagaataataggacttacagtgtttctgcgagagttaatgacatatttcatctaattataatcacatggtataatttctccttgtaaatattcaatatatggtttttgctgtcatgataatgatgccaacttttcgatttcaagtgtactagtactgtgcttctactttgttcttattttctacccccagatgacccctcactcctcattttcatttttgcccacgcaccaccatttattcacacacacacacacacacacattcatgattgtaattttgagaagacaagaaaaagaagtggtatagaaaatagaaaatgacagaagaatatagattttttagcttcttctaacttcctcactcccatctctttggaaagagtaattgctacttcagctatttaaatatagtattcagagcaaacattggcccaagaggttatttcaaagaagaggaaaaagactttatgtcaagtttgtccaacccatggcctggggcccccatgtggactaggatagctttgaatgcagcccaacacaaatttataaactgtctgaaaacattaggagattttttttgcaactggtttttttttttttttttgattcatcagctatcgttagtatattttatgtgtggcccaagacagttcttcttccagtgtggcctagggaagccaaaagattggacacccctgctttatgggttctgaggtggagtgttggctaggactcacttataaaattttttttaaattttcttttctgagaaaatgaggaatatacatggttatataattcacatacatatctgaaattggtattatattaacttatattaatttgaactagaaaattatattcaccactcatttgtggtgaaatttaattctttcttcaaagtgtgaggaatttgccttccttgccatctcaggaatgctccatgactactttcatctatattttaaatattctatcactaatacataatgtttgtttaattttcaaattattgtaggttctgtctctaactggatcattttcttctttttagagtatttatttcatttgcatccctgcttagtgtctaatgaaatatttaataagagttactgtcagtttctgtggaaagatatagaattgggaaaaattaaaaaatgcctttctaataagaatgtctttttttagatggagtgaaattgtctgtattttatttattttaatttaatttaatttaattttattttgtttttgagacagtctccctctgtcgcccaggctgcagtgcagtggtaccatctccgttcactgcaacctccgcctccccagttcaagcgattctcctgcctcagcctccctagtagccaggactacagatgtgcatttgtagagacagggtttccccatgttgcccaggctggtctggaactcctgggctcaagtgatcagcccgcctcagcctcccaaagtgctgggattacaggcatgagccaccgcaccgggccttctgcctgtcttttaaacttggggtccccagtccctgggccacggaccggtacctgtctgtggcctcttaggaacccggccacaaagcgggaggtgagagagcagcattaccacctgcgctccacctcctgtcagatcagcgcagcattagattcttagaggagcagaaccctattgtgaactgggcatgcgctcctcatgagaatctaatgcctggtgatctgaagtggaacagtttcatcccgaaatcctgaaccatctcccatcccccattagtggaaaaattgtcttccatgaaaccggtccctggtgccaaaaaggttggggactgctgttttaaacaacaaatcagaattctcagatatcttcttgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtgggtatgtcaagctgcgttgtgtcttcatttgtgttagcagatttgtatgcagattgatgcagatttaatgttatattttgccattttctgatcacattagattttgaaaaaaaaattgttcctgtttacagtggtattgagaaaatcagccttaggaagttttacagttttgaattcatttcaaattatttatagcagactttttttagcaataggaatattttctgcacactattagatgaaatacatgggtcattatgaatgaattttagtagtgtttttctaaataaggcattattttatgtttttgttccaatgtagttatgaaaacatgtaatatttgtaatccaaacgtttaatttgaatattctgaggttctcaataatctgagtactcataactcaagcctttaatttgtgaggctatgtagggcacagaagcatttaaaatagctaaattgaagtggaggaaatagacaacaatgacatacattatattttaaacattcttttcaaaaaacttttgatttcaaagatattaagagagcccttggaaaatgtgatatattctttccggttcattgtgaaatctctgagaaatgattgtgcaacaggaatgcaaaaatatcttttggtgctgttacatatgtataactaaggaagcttttgtagatcttttctaaatgtttgttttcaagataagatgtctaaaaacaaaacaaaaatgggattttcagtgaattttcccctcaaataaaatattcctcagtaggaaacatgttagaataatgttccataaaaatattaatatatactattttgttgggggattatgtcaaaaatcaatatttgagtcattatttttcaattaattaatacacatttgaattaaaacctataaccaaaaaatacacgataagattgtcttaattataagatttctttttcaatgtaaagtcccaatgaattctctccccactgtttaattccattttaagtgatttttactgcagtgatacttaatatcccaggatagcaaggaaccctcctacactcccccaaacatgcacagataataacacactcacttataagatatgacaaatgaagcctggattcagtaacatatgttacttgaataacctatggtgttatccttttcaaaactaaaataacgagtttaggttgggcttatattgcctacttagtactagaaagtaactcaacgttgggatccaaataccatctccacttattactagcctttaaatccggactagccacacaggcactatgtgtctgttttgtcatccataaaatgtagacagctcctcataccttcccagcatgggtattgagggaatcacgtaaactattgaacttcaagcatatcctttctgcagactggatattcactgccagtctgcagaaaggatatgattcatatgattcagttaattgcaaacacagatttaacctcttacagtctcttgaatattgatacttcctttcctgacaagaaattatcaagaggtgaaatacagtatatatcatcttcctgggttggtggagaatgtctttttgttctatgaagaattgaataatcatgataaactttacatgacggaaaaagtttaggtatttttgttatcaacagtcaaaagtattattgttgattgcttaaaaatgattttaaaataccatatgaaagggagactatacctttacacagtgttggtttttggcaagtgagacttggagcaagagaataataaacacccatattgtgccaatccaggtattaagttttccctgtgaatcataacagtagcatgatttataagacatggggaaataaatcaagaaggtaaaccctggaactctatcgtcagttctctcttaatttttcttacacagagtgtctacatttggccttagttatggtttgggttatttaggtttctttttgttggtggtggtttgttggttggatggtttcatacattagcccttcagcttccctttttgctactgcagttgtttcctgcatattccagccaagggccatctctcactttagattgtccactggcaggggtgactgtcaaaataatgaccaagaggagggccattccagctgcaatcccagaggcctctgctgtaccaggcattgaccttttaggttctgagccgtgggcaggtgtggagggcatccaacctgagcagttctggaggagatattcctcaggagagcacctctttaccagttggtatggatgtacttaatatttttaacaactgttttgacataccaactgaatatatgtcctctaaatggaatcttctagtcttagtgcagataatcaagacatgactatgtaaatgtagtgtgtatcataaagttgatgcttggagtcataacagagttagggcttcagagacgcactgttatgcttgggctttcaggcttttagtttaaaatatgccacatttccatattgcctgttattgtcaggaagattggccctcaaagttaaaaattaagaacttgggggaaaacttatgtagtgaatctaagcctaaggtagtttttactttagctctgaaagcagcatcataaaaaggtgataggaaaacagggaagataacctttttctttgcatttctatgatttttacattacacctttaaacatgtcttgttatgtacatatacgtatctattttaaaaatcacttgctattcagaccatctttgcctctattactgcccattaaaagcctgttttcctcagattatagaaaaccaaggctttgctctgagagactatctctgaccttgacctagaaatatttaatgatacacagcagcataagagtttcacactcacacatatggaaattgatgcagtccatgggttttttttttttttgcctttaattaaagttcaatggagaacagtttgttattgatatttagcatgtgttcagcatggtatctttttttttttttttgagacggagtctggctctgtcgcccaggctggagtgcagtggcgcaatctcggctcactgcaagcttcacctcccgggttcatgccattctcctgcctcagcctcctgagtagctgggactacaggcgcccgccaccacgcgtggctaattttttgtattttttagtagagacggggtttcaccgtgttagccaggatcggcatgttatcttttgcttgcagagccaatggttcaatttctaatcaggtactactactagctttcagagtaacatgaataatgtattgacttttttcagtcaagtctatatttgcgaaaaagagataaatccctcttttaatatatcacataaagtaatagggaaacaaatgagataatgagtgagaaagttatgaagaagatattgcttgatgaatacagatgtatgaaaatataacacaatgtttttaggcattattactatttaaattaccatcacttaatactattgtaaaaatttctagtgaagccactgcctccatccagtgtgaaagcagaaattactataaacattggattattgaaaatatcttgggaaaagccagtctttccagagaataaccttcaattccagattcgctatggtttaagtggaaaagaagtacaatggaaggtaccttttacttagaacttcagctttcctcattaaatgctatttttataatatgtaagagtttaattgcattagattaattttattggcataaaagtacattctcctgtattgtgtagctattttcattaaatagatttatctaagtctaacttttttaaagaacaaagtttcctgaaatccatcattccctgaagtgtgttttatagaacgttggttgcatattatgttccttggaaaaagattaaatggctaaatcagtttaggaaaccctgtatcactgtatcttccttgtgtagtcacggtatacatattacatattcaaggtttggagaggtccttcattaaagaaaaatttgtgaccttatttcatctcatgttccccaaactaatttttccaaggaactgttgtttctctaacatctgttgatatcttttagtacatacatgtttagtggaatgcattttggaagaagctgcttttcaaacaaacagagtcattcccgtagtggcaagtgtgcctatcatggcattccacatcagctttgtgacggcagcctgcaaagacctagaaatatcagaaacccttattgtatcattagatcacaatgatatcaactaaaacaaatgtgacagtttagctgctattgaagaatactgaatatcagcgatttgctacagtaggtcctatctaaccaatacgtttaaattctttttaaattcttaaaacatctttgtgggtagaggattagtggacagggattagtaggagggtaagagagtgtttgggaaacaaggttgcaagtaaaccagttcaaaatcttgtcatcatcagcaagggagtgacaagataaataagaaaatccttgacttgaaggagtttacaatccaagcctaattgtgactatttctgaaggcagagaacacagaatcagttctcttaattttggaatagtgttaaggtttaaaataaaatgtacttcagggccctttagatacatatgtgttggtaatgatcaatctaatgctttgacttattttacagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaaggtctgcagagattttgtaaatgtgttttgaaagtgcataagtgtgtgcttcaaatatggctgaaaagtatttcttcaaaaacatatacacaacttgtcattttgcagttcctatgagaggacctgaattttggagaataattaatggagatactatgaaaaaggagaaaaatgtcactttactttggaaggtattcccaattttaatattaatcttaaattgtatttttatactcttaaaaatttacttcatggtccataatcctgttattaatcttcggaaagctcaacaatcctgtattttcattgcatttatgagatgtatttaaagagagctaagatgtacagtggctgaagcactggcatagtgttaggagactttcattctcttcttagcttcacatattatagttacgtcagtactatttgggcaaagttacttagactctttgggcctcagttttctcatctgtgtaaatgtaatattgaactagatgataggcagtgtttcttggagtctaaaaattgtattcatatttaatcctgaacaatgtaaatgtcaccttccccgcacaccccaagggcatctaacacatgacagagtattccatttatgtgatggcataaaaacagtggatagtcccatatatgatggctgtttagcctagtaattttcaaagcatcctctcccaaatgaactgatttctatttcaagtgaatagtttatttggtcagtaaatgccaaatttaagattgacttgggaatacaacacatgaagtcaaagagtatttctgtcactccaaatgtgaattgtaagtttaatacccaaggttgaatgagcacatgtttgaaaatggtttcctgatgtaagaccaaagcctctgtaaaagttgtggtatataagaatttatgttcatttggtttctaaatccagttactctataatttcatttggtgaataatcaatgcaatttctaaagtcttccatttcaatatttcttaaaataattttttattcttttatttcatttcttttatcattgctctccttaaaaaatttagtttcttttgttattgctctcttttctttttctagcaaaccattccttcaacacattttaatatttccaacttaaagttagcattagaactgacagacatttatgagccatttattgtattctgaacacttcatacagatctccacctcccggggaattcaggacctgtattctgagagattgagtgggcggttgaacccaccgcggaagggggcactgctgaataagaaacaagagtcttgcccgacagattatttttctcatatttttggttttatctccatgggcactgttccagatacctgcaaacttctacagtgaaggacaggcagtgatgttcccatgtttgtggtagggccagctatgagcagaatttaagtagcttttctttttctttgatttgtcctctcagagctgtagtcaacagccctttggcctaggctacagctaccctctcccattgcaatatactctagaacaaaacagttgtctttctccagacagttcttatgttttcctcatatcatggattccacatttcctcagcaatgctgccaatagaagtttctgtaatgatgaaaatggtttatatctgcattgtccaatatggtagcaaccagccacatgtggttattaagcacttgaaatgtgcctagtgtgactcagcaactgaattttaaattgtatttaattttgattaatttaaatttaaatggctgcaagtggccagtggctatctttttggacaacaaagctctatgggttctttaggggtgatttgtgggagggagacaggacccttgctaatctaccatctttgcagaaccttgaatgccttttattagtcaatttgcctttcattaattttgttttgtgctgttttgttgtgttttcctaaactgagataatagttcaatgattacggttctccaagcctatgcctcttaaaccgggataagatttgcttaaggagtaagccacaaggccacaggataagtatggcactttttaaaaaatatcatttctctggcatttttaaaataataaactttacgttaaggcagttttagagttacaaaaagacggcaaagatagtacagagaattcctatgtattcccacaccaagttttctctagtattaacatcttaggctagtatgatacatttgttacaatgaattaaacaatattgatatgtcatcattaactcatctgtaatttatttcaaatccaaatttccttagcttttacccaatgttctttttctggttcaggattccatccaggatagcagatttcatttagtagtcatacctccttatgcttctcttggttgcaaaagtttcttagatcttctttgtttttatgaacttgacacaattgagaagtactggtcgggtattttgtagaatctccatcaaatgggttttgtctaatgttttctcatgattaatttagggttatgtgtcatacctccttatgcttctcttggttgcaaaagtttcttagatcttctttgtttttatgaacttgacacaattgagaagtactggttgggtattttgtagaatctccatcaaatgggttttgtctaatgttttctcatgattaatttagggttatgggtttgggggaggaagatcacagatgtaaaatgccattccatcacatcatattaaggatacattctaccaatgtgacttaccatagttgatgttaaccttgctcgtctggctgaggtagtgttgtctggctgaggtagtgttgtctggcttcccactggaaagttactcttttttctcctttctccattttagttttaaaaatgaagtccccatgcttaaggagtaggagtcatgttccacctacttgaaggtagaggacctacatatattatttagtgttcttctgcatgggagatttgtctgttctcccacattaactattttatttattcaatcatttatttatattagtatggacaatgaacatttattttagacttggtttgtaatccaatactactttattttgttgctgaaaatattcctgcttcagtcattgggagctcttttaattgactcatgttcctttgacatgcccccgtcattgtggggttttttattttaatttttgagtactggtaagttcgactttattaaaattaaaaacttctgatctgggaaagactgtcaagaggatgaaaagttaaggcacagactgggtgaaaatatttgcaaaaacacacatctgataaaggacttataaccaaattacacaaagaaatctttaagattcaacaggggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaaccaagtatctgaacaaaaacctagccaaagtagatatacagatgacaaatatgaatattaaaagatgttcaacatcattcatcactaaagagttgcaaattaaaacaagataccactccacatctattagaatggctaaaatccaaaaaaaaaacctgacaatacaaattgctggtgaggatgcagggcagcaagaacttttattcattgctgtggaaatgcaaaatggtacagccactttggaagccagtttggtaatttcttacaaatttaaacatagccttaccaaccacatgatgcaacattgcatcctaggtatttactcagctgatttgaaaacttaagtctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctctgccatttctaacttagaggcatctcaccggcaagaaattgagatgtactgttctagtctatgatatacagtccagccttctctgtctttataagggattgccagcatttaatcttacctgccataggtgaagttgattggggaaatggggtacactgttaacctctgtggaatataagaatagaattgaactagacacttattttacattcggatctttaatgacctgatattattatttttaattatatgacagaaattctggggtgccatagacactgttttgatggcctctgttactcattaacctttgcagacattcttacattctagataatcttccaagagtatcagaggaaaggaaaatgaatgacaaatcttactatgatcaatatatgatgattaacaccttcacagctcttgttgttgcttttcattttctgagggttattccttgtttgctttttagatgaggaaactctctactccttatgtctttcatttctctaaaattagagtgaaacttcttggtagaaaagtgtcttgatcatatccctactttattatcttcaagtgatttattctctgggccttaagaaaaaaacctcaaaaaggggaaaataagtttgctatgctccataacgatccagacaccttcatggagactgtggcagaggcaaactctatcccacccatctccccagcctctcagccttgtaatagtacctgccctgatctggcccctgcctcctaataagaaatgtagaatgagagttatgtgagctcagttagtataaaaagcactgcagcccttaaactaatcaatttctatatttactacagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaaggtaagaagaggtacagagtggtaatccattgcctcttttaatatttaacttttgcaaactctcctattttaaattatctttcaagcagcctgcaattctctgcatctgaaagtctctctttcacctttcatttcctttgtctggaaaaataacaaagtacattgtacaatgatcacataatacagtccttgagctttcatttgggagaacattgttgtaatggtgttataatatatgagaatgttttagtgaatctaatacttaaatcttttggaccaatggagatctttaggtcaataattctctctccctatgtacatatacatgtatatatttatattcatacatacacacatataaatatgtaaaaataagtatatatcatattaaatatatatttaacactatgtaaaatagtaatagcatgacatgttatatggatgcaggttaattgctgagacttaaaattactatggacttcattgaatgtgagtagcaaaccttcttgcattaattttgatatatctgattaatcggagaattgagacccactttcaataggaatttctagtctagattacatattcaaagtgtaaatttttaatggaaaatacaaattttctgtgtctctaccaatctataaaggcctttccaactgttacctcctttatgaaatctttgcttattgctttaattgaatatgccctatctcttctttaaatctcagagtgcttcctgtctttcttattttatgtcctgtttacattatgattacctttgtatttatagtgttaagcatcgagttccatagcacccagctcagtgttttatgcttaacatttcctaagtatatatattctagaaatatctgtagaatgcgtcagtggggtaggtagtgggaattgtaatgtgagaaaaactataatggttggagtgtccagagcctaataggtaagacaggtattaatgaaataatcatacaagtgaatgtctatttgcaaactgagagataagggcctgcaggaaaggaatataattttatgaaaggaatgaaaaaaaggaacctgacctggcattgagattcagagaagccaccttgaggaagtggtactgaactgaaatctgaaatgtgagtaggaattaaacttccccaaaagatgtaggggagggcaggaaaagcattggctcctaacaagagcagccagatcaaaagtctatggcacaggatagaaaatgaagaaagaccagggtggctttggtgtgggaaatcatggaaggcagagaggtgcgttgagacttggccctcagggccttgcaggcatgataggaattttaccctcaaatgtagaaatccgctggaggcttttaagtgggatgctgtgcagatggtgttaaaatgaacagatttgtgctttgagagtatcactccatcagtgggagaggatggttaataggcttgtgcagtattccatatgagaatgcctttttgaatatatcaaaaaattgctttttaaggttttagggagtatcatgtttctcttcaatgtcatctattcccatatctctctgtttaaatgactctcatgatgcaaaagtaattgtcatgtatcatatttatttgtgtaaattgtctgtcttctcttccttattccctttagtaggttataagttcctcaagagtattagtagatttttattaatttttaatttaaaaattaatttccttcttttcccctcagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatggtaagtttactatactttagtaagttgctctcatggattaatatgacactacagattattaattctattaatatagccagttaatgaaaacttcaaaaatatagaggatactaccatcctaatacatataatcctataacctttatcaaaacatttaattctcttcctcttctcttctcttctcttttcttttcttttcggcagggtctctctgtgttgcccaggctaaagtgcagtggaacaaacatggctcactgcagcctcaaccttctgggctcaagctatctttccacctcagcttcctgagtagctgagactatagacacacaccatcacacccagctaattaaaattttttttttttggtagagacaaggtctcactatgttgctcaggctggtcttgaactcctaagctcaagtgatcctcctgccttggcctcccaaagtgttgggattacaggcatgggccaccacacccagcctaattctgtttcctttgacattttctcattttaacattttatacaggggttatcatatcatatcatatcatatatcctatcctatcatatcatatcaattttctcctcatttctttctaccattatttttaatgatatagcattttattccaaagtccacttaaactgtttgagattctttatgttgcttccagctttatcttttcttaaatcattttttaacagcttctgatatcttctgccaaattgtttcctcaaactgtgtaccaacttataatgccactaacaatgagtgggaatgctagcctgaaggtctgaggagctaggactgggtgacctagaccagggtattctcccaaagttagaccagttattccaggaggtgagtcaagcacaaagtataagtgcacaagacagcatttctaagtctgagtaaggattgaggaaagttaactagggaagctaaggattgctatgatcttattatacaatatcattctaaggactcataccattattttattccagggacctagaatttagcatcagggtaaatttatttacaaattgttgaactgaatttagttcatcaccactgatgcgcaggtagtttctctctgtgcttttctttaaaccatgaggatataaaatttaggcttcacagagatctctcttcttctggatatattcttctagaagaatattcatatattattagcatttgtgaaaatcatgatggatccatctggagctttgctatagggttggtcattttccatggatcaaaatcccagatcttgcaaggggtctcgtggtctccaccaccattttgtttgcataggatttcacaagactttagtctcccagctaccttgaatggaatggggaaactaagtaagctgaattcctattaaaaaaaggagtattgcccactttgggggtaagggagaggtagtagaacatattgctctggaaaaggaaatgaaggaaagaaaaagctcatacaccctgcacttgaacaaattggctatcactggaacatgcctttgaaaaattgcaatcttctgtctctggctaagatttttagaaaaatatttggaaaactattgtcatgactagataattagaagtgcttaagtttgttttgaaactcccttgataatttaatccacaaataataagtaatttctatgtttggaaatatatgatagtcactttaattcttttttaaaatgtatgttccactcattactattaattttgtataaatgagccttttacgtatttttctcctcagatcattttatccccattgagaagtaccagttcagtctttacccaatatttatggaaggagtgggaaaaccaaagataattaatagtttcactcaaggtaaaaattataattttagtttccttttacaccaatgtgtgtgcctaatttgtttgcagtaatattgccatctgattattctttttctgatagaatcatggaagagtccaaagtcttctgtagatttttcatggtgaggttccaaaggaaatatttttttcctctaaaaataaaactggagctatagaaatagagtcactgggcctcttatatttctgattcatcttactgtacttggaataccaacattttgattttgttattactttttaaattgtcttcaaatctaagcaacctagcaatgatatttcaagagataaacatttcatttgttgttagaataaaaatcattaaaaaaattcatacatgtattatccaacagatattaattgagcattgttctaagcactgtggattgaatagtgaacataagtttctgcccttatggatcttaaataccagtgctctaattgagagtgatgggcaaaaaataattatataatgtcagatagaaataagtgccatgaaggaaaacaaaagcaagataaagggatggcattaaatgtggcactttagttgatagccagaaatggtctttctatggaggtggatgatattcgagtaaaaccttgcaagtacagtaagaccctacttgatatagtcaatagattcttggaaactgcaactttatgcaacatgaactacaggaggtccttgaataacatcattttgttcaaggtagtttcattataatgttgatgagaaaaaaaaggttttgttatacattgccatttcacttaacattgcagtttccaagagcctatcaatgatgttcagtgaagacataactgtacaaatagcaaaagcattccaggcaaagggacagtgtgtgaagagcccctaaagagtggggatgcttggtggttcaagaaacagcaaggaaatcagtgtgtgtggagtgaacaagatagagattggcaggtgtggaaggttgggtcctccaggagtagatactgagacagtcatcataacaagtttgacactttggcccattataatgtaaaaatgatcaggtagagaggaatggcaaataaataaatttgaaaaaatattttgctaatttacagtagatatgatgctgaacaaaataataagtattttattaatgtgatcacaacatatttttatcttcattttttatttttatatttttgaaggtaataagagatttgtgatgaattcagaaaatgtctactataatttttgatacagaaagaaattaatatttcctcaagtttctgagttgtgtaaattgtatttctttttcagatgatattgaaaaacaccagagtgatgcaggtttatatgtaattgtgccagtaattatttcctcttccatcttattgcttggaacattattaatatcacaccaaaggtattgtacttgaggttaagaatctttacggcaaaagtccttacgcgtattcaaaccctgatttaaaaccttctaaattaggaatattaaagtcttctaagtgcttttatatgtagtctgtatacaattaagatagcataaaaaggaaaggcctgttgtgaggaaatggcattccattttgctaggactgtaagagttaaagaatgaggaaagaaacacgaaacacagcttaacagttaaagacaggttttctttagataaaacctgaggggcttctggccaattttgttcaggagcccctttctcttacagactaagagtatgtattggttttagggtgagggggcttatcacaagcttggaatgtttatgtgtgagggagaagtttatggcggggttggaatgtctctgggaggaggggaggttatcttggggctgacatctttccagctggatggggagggttatcttggggctggcatgtgcctggtcagggaggatggaatgtttctggttggagatgttatttgtggtttatggtaatgctgaccttagccattaggctgatgccctttggatttaggtggtttttgattaaggggaattttaatatgaggtgcttgtccatgatggtgatgctcctgctctgtcaaggacaacataacttcaaggaagaatttagttttttaaaaaaaatgtacatacattcaggaaacaacaagcttataacaggaaatcctaagcagtatgttcttggaggtggcaaaaatggctttcagagttctgcagtttgggttaaggacgttttgtggtgaagtgggtggtaaaagtagccttttagtggtgacctggagcagtcagttcatttatgatcagcaggcactctgctttttagagatcagcactgtgtggctccagtctgcttggcttgtcaggcaaatgcctgagttccgtggatggtggcatgggtgccatgatactctctgtgctgagaagtccagtgtggttattttacacatgccaaatctctgtagaaaccatcgtcttcaggcaaaaaagagagagaggagattttagaatctgaatttatcttgtagttaagtgagttgatggggccacatcaaatggaattttttctggtacccactttgtgaccatttttaatatttcaatttctttgagagaaatctatccagtgtttagcatggtgcttggcacacagctttcaataagtattggctatttctattattacagtgattttcagcttgggtctagataaaagtttggtagaaatcttcatgggctagcatgtgaaaatgcatctgaccctacggaggcatagttgatctggtggactaatttctagcttgtctgttcactaactgttcacattttcaatatggatgtttttctctaattttgatgccctgtttatcctttgtagaatgaaaaagctattttgggaagatgttccgaaccccaagaattgttcctgggcacaaggacttaattttcagaaggttgctttttcaattttttttaacccagaatatatacgattgcaatctagacgccatatgacttatagagcattaagcatttttaagatttaaaaggtcatattttattcaattcatcttaatatatctgttattatatactttcaagaatagcaggatgcagggatttgaaatcaggaagaaacaaatttcagcgcatagtttatcgtatgagagttcacaatatacatatgttgcttctgtgtcacagtacataataaaataaatattagaaagttaagggtcaatctgatggagaacagatatttggatacactttttttggtataaactgtatttaggcaaaaggctggaatcaatatttttaatgtctataattatctccataattatttaaataaattagaaaattatataatcctcaaacattacaatctgaaaaatgcagtgatcataataaaacttatatttatgcagaagttccattcaagtacaagtactttatgagagttagtcaactataataaaataatttgtatttacttctatagtaggatttttcagaaagctctaaatttagtgactgttttattaattctcataatgtcccttgaagcaaagctagctttccactcataaaactggaaaaatagaattcagtcaagtcaaaatatacagatttttaaacaatacttatttggaggttattatccaggtttggtgattgcatctttatcattagtcacttgttaaaagttttcaatggtttccttttgaatacaagatataaactaaagccccctgaagctattaatagtactcaaggacctctttctacaatctgttatcaacctacctatacgactttttctatccctgggccttgatgatacctttactgttcccatccaccttcacagagccttccttgtacatgaagatcttgctctaggcccttctttcctcaagccttcctttaaccagtgtaattcaaaagaatttctaccccctttaagttcctagatcattgtactgtttttttaattgtggatagtgctctgaattcaaagactgtattttatccatcacaaatatttgtagtactcctcctgctgttctttatgtgcaaagcactgagatacatattcttacatttattaagatttttacttacattctcaatgtttcagtttcctcttctgtgaaataggctgcttaccttattaggttgtttgcgggactaaagaagatggtacttgtgacatagtaaggtctcaacaaatattaattattattgtacatatttatgtattttatattactattattattctttcagttaccctatgggacaagtgttattctctctattttgcaaaagagaaagctgaagctcatagtggttcggtaacttgttttagaggcaagattagcttaccagtttgtctggctttggagcctgttctaatagcagctgttctctatagcagtggcttctttttctttctttcttcttcgccatgacccacagtgaaaaaaacttaggttggtgcaaaagtaattgcagttttggcatttttaatgtataaatacgttttaccttccaacctagtacaccatagatacagatatgcaagaccgaaatgaaagatacgcaaagcagctttacttcttgcttgaaatagaatgttttaaaattctattttatttgttaaaaatgctggttgcaagacactaaattgatttcacaacattcgaatggcctatgatttgcagttagaaaaacactgttctacagcttatcaatgaataagtaaacaactaatattgtagacataatgaacaaagaaaaagattgaattgtaatttttcagcaggagaaagaatgccctgtcttcagaagcagcagtagtgttgttttatatacgaacaattctttttatagaaacttcgctttgcctgagtctaatcagccacactcctatatactcctcacctgtgctgttgctcactaagccagagtcttctttcattaaaacagtgttgccgagtttttcaagtaaatattttttctctcatttatcttttactaagaatttatacagtgacattttgtgtagttgtgatgatatttcagagagagatatatatatgtcgttcattcatttgttcaacaagcacatggtgagtatttatatgtaaggcttggctgttgctagggtctgggagaacagatttttcttaccatatgagaaataagacagtgaggtcagagaagagtggctgggttgaaagtagaataggaagagcttgtctccttttgcctctctaaaatagttcttttctattcatttcatccatatattcaatatgattgaatacttaccctataccagtcactatagtatgccctggcattataaggataagaaaaacactatgtgctcctgagtatacagtttaatggggatgataatcattaatacatttatcatggaaatagcattactttttttttgtacaaatttatggggcacatgagaaattttgttacatgtatataacatataatgatccaatcacaaccttatagttgtaaactacatgttgtgaaagaaggggttccattgtgctgagcgcttataatgtgggaacctggcttagtgtatccgtgggggtgagtggataaagttaagcaaattacatttgggccaagatctggtagatgaacaatcattaactaggttttgaggcagagatgtggtgtccagctaagtacctgcaaacactaagtcatgtggaaggcagtacctagcatattcacaaactggaaataggaagactataagactttttcttaaatatgagggttttatgtcaaaaaacctatatacttatctaagtaaaattgccaaattttcagtatataggtatatattaattcagggaatgatcatcttactttttaatgtcacttaaaaagaggctgaaacactctctcttcagcatttaagctctgaaatcttacctatggaccaccatgaagtggtttctcagtgttcaggagggccatgaaatgatcaggcccacatcagcaaaatgcagtttaaacctgcagcaaattatttttcccttttccagaaaatgcctggcacaaaggaactactgggtggaggttggttgacttaggaaatgcttgtagactacgtcctacctcgctgccgcacctgctctccctgaggtgtgcacaatgctgccacaggtcatctgacagaccttatatacaagtagattgaaatattgccacattttttcaagttctggtaaattaaagaaatgtgaagaatttttataatacagtgggtgtgaatgttcttatttgtaggactgattttttaaaaatctctggaaatatttgactttctaatcttataaattattttttaagcacagctaacccacaagatgcttagtttattactagggctgaccaggcgcataaataacactattaggaataaattaggttttggaatataatagaacatttaaagagtaaaggagaatataacttcaaagattttattaatgataaaaatcttctaaaattcattaacttttttctctttagcctgttgttttaatctcctaaacaattaaaatgtacccttttctttttgagacagggtctcgctctgtcacccaggctggagcgcagcggtgagatctcagctcactgcagcctcgacgtccttgggctcaactgatcctcccacctcatcccctttagtagctgggaccataggcgcgtgccaccacgcccggctaatttttgtagatatggggttttgtcatgttgcccaggctggtctcgaactcccaggctcaagtgatccacccacctcagcctcccaaaatgctggacttaacagatgtgagccaccacaccctgcctaaaatatgctttttaaaggaaaaataatatagtgtaactcactttatattactaaacaggaaaaggcaaatttaccatccaccctatgtttcatattcatgttatttaaattatttcatagggctaatagccttatattttctgatgataaaactgaggcccagagtggttcagtagcttgtcttgctcacccagcctgtccatgtaacatctgtggttcaaatccagatctatctgactcaaattgatacccgtgccatcagttccatattaacaatgtatttcttaatatgcttaatgccactaaattatacacttaaaaatagttcaaatggtaaatattgttacgtatattttaacatcataaaaatgggcaaatgatgtgaataggcatttctccaaagaagatacacaaatagccaagaagcacaaatgaaaatatcctcagtgtcattagataatagggaaacacaaataaaaaccacaagatgcccagtaggatggctataataagagacagatagtaagtgttggtgagaatagagagaaattagaattatcatatactgacagtgggaatggaatagcaactctttcggtaaatagtctgacaattcttcaaaaggttaaacatagaattattatatgatccagtaattccattcctaggtatgtactcaatagaaatgaaatagcaaatccacatgggaagttttataagaatactcatagcagtattattcataatagccaaaatgtgaaagtaacccaaatgatgaataaataagcaaacaaacaaaaaactcacactatattgcaaagaaagcagaccagaggagcctattgtttttaaaaataattcaaatacaaatatagtattttttaaaggaagtaataatttctatatcaagtgtttcctttaatttgttctccaaattcagatattttgaatattgattattatgaaagtactcttaacctgaaatttctagacatctaacatgattttcaaaatcttccctaaaattaatctattccacttttgaagctgtcattttccttccccttggtttatattaaatctaaatcctgaacctataattatgttaatcaaatgtgtttttaaaaatccaatattttgaatgtatttctaaaagaaaaatgaaaagaaaacatttatttaaaaccactatatgccagacattgctaacaataggataataccatatgtgattaaaaataattttgccaatataatttcctgccagatcttttttcttttgtatgttccacttccttttctcttttaaaattagtttttctggataatataaagatgaaaatataggacaatatgaaaacagctctatattaacacaatattttaaaactttctgcattttcttcatttttaaaataaataaaaactacaggtaaagtttgtcctgcttgttccactatttccggtccctcctcttcctggaggaacccatgatttcaagaatgctgtagcctgtgtttgtctagtttgtgcatttatactttcctactttcacatgtgtgtatccatgaccaatgaagagtaatcctttgaagtactgaaaatgttaatgtacctttcatattattccaaaaatatctctgaacattgtgttttgagctctctccaagttgatgtagttaatttagttcacacatttggactggtctgtagtattccattatacaaacatagcacaattcatttattcctctactggtggatgtttaaggtgtttgaacacttttttatatttattacaaaaagtgctgcaggaagtatggttgtatatgtctctttgttctctcatgtatatgatatttctcaatatttaaaattttttgaaaaaatatatgtgaatgacttaataatgaaatgttacagttaaatatttgagtttggaagaccacttcatgaaaaggacagtccccttttccacccctccgtacccttagtcttgctctccaaatgcctctttagttaactgtctgacttttggtttttctggtatgtcacctttttatttctaaaaaccatatgcttatgccactatgaaatgtagacggtatctattgatttctggctacaacgaggatttactcccacacattattccctccttgtgtttctacccatattgtcttgtcacttttttcaattccttaagtaatcatttctccaacctcagaaaaatctacttaaacttccatttcttgttcttttaaacagaagactatttcttggagctcccctgctatttttttttttaaataaaaacattagcactcttacgcttccctccatttctccctctactttccaatctctaaatctaagtttatgtttttccttaagtcagggttgatatgatgttctgtgttgtaatttgtctgtggtttatttttaaaaatagaaaaactaataaactgaatttgcattgttatgattatgtaaatattgtgacttactgaaccaagtatttaataatatgtgattacacttctcagtggttccgatgtcaaaggggaattttttaaaaaatatattagatatattccacctgttgatcaaaattgtgccgaattttagttagcttcatttttagtttttatcttttttcttttccttaagtttctaattgtcccttccttcctcttcctccctccattctttcatccattcatccctctctccctccctctctttctttcttttcatgctgtctttctttctccttccccttctcttccctcccctcccattatataatctatgctgttatgttacctattttatccactaccccatctttactggaggtgttgttctagtggactctccaggaactcctctatcctcctacttcaatcaggactaggctttctctaaaattactataagccatcactctaaactttcccttaactggtttctggttagtactgtttcctggattcctttccttcatctttcttaactacacccttaagtaacctcctaagaagtatgcgataagtctccatctctccatgcctgaactgccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataa

SEQ ID NO: 1952 - DNA, 262040 bp, Homo sapiens
gaaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 1953 - DNA, 262040 bp, Homo sapiens; identical to SEQ ID NO: 1952
